United States Patent 11,098,302 (IDENTIFICATION OF POLYNUCLEOTIDES ASSOCIATED WITH A SAMPLE) - sequence listing, part 97

SEQ ID NO: 334357 - DNA, 636 bp, Homo sapiens
  misc_feature: GZ8MTXP02JFKGC.25.35.D02.1.454.CMB.2.raw
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgacaactggcggaggtcgggggagcgtggtccaggccgggaatccctgacgctctcctgtgcagtgccgcgtccaccgttccgtcgtttggctattcacgtggtcccgaccaggcctccgaggcgaagggctgggagtggggnggccggtcagtagtgggtaggatggaaatatgactatttgngcagaccttccggaggaacgggcccgactcacccgtatccgtaccgaagcggccagtccctaaccgaaacgtaaccttaccttttataccgtagtaacctaaagttacggaaaaaccgtgaaacgtacgtacggaaaccgacgaacgggtcttagtaccttaagtttaccgcggtcggtaccggggtactaaaggaacgaaacggtcggggtcccgggtaccgttacggaacggcgtaacggtcgggaacccgg

SEQ ID NO: 334358 - DNA, 643 bp, Homo sapiens
  misc_feature: GZ8MTXP02HSYQ6.25.35.D02.1.454.CMB.2.raw
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
  modified_base (381)..(381): a, c, t, g, unknown or other
  misc_feature (381)..(381): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgctgggtttttcctcgttgctcttttaagaggtgtccagtgtcagatgcaactggcggaggtcgggggagcgtggtccagccggggaatccctgagactctcctgtncagtgtccgcgtcccaccttccgtcgttttggcattcactgggtccnccaggctccaggcaaagggctggagtgggtgcggtcagtagtgggtgggataggaagtaatgactaatttttgngacacgtaccgtccggtaggacggcccactaccacctatcctacgaagacgacacgacctaacccgaaacgtaaaccttaccttttataccttacgtaactaaacgttaacgaaaaccgtagacgtacgtaccgaaccgaacgaccgtcttacgttacttaacgttacgtcggaccgggtacgggttaacgacgggtaaacgaaccgggtaacgggggtcccgggtaccgttacggaaccggacgtaacggttcgggaccgg

SEQ ID NO: 334359 - DNA, 659 bp, Homo sapiens
  misc_feature: GZ8MTXP02HWEZP.25.35.D02.1.454.CMB.2.raw
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (390)..(390): a, c, t, g, unknown or other
  misc_feature (390)..(390): n is a, c, g, or t
  modified_base (484)..(484): a, c, t, g, unknown or other
  misc_feature (484)..(484): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgcttgggtttttccctcgttgcttcttttaagaggtgtccagtgtcagatgcaactggcggaggtcgggggagcgtggtccaggccggggaatccctgacgactctcctgtgcagtcgtccgcgtccaccttccgtcgtttgcattcactgggtcccncaggcctccgaggaccgaagggtctgggagtgggtgacggtanagtgtggnggagtaggtaagtatcgtacttatttgngtacagtaccgtcgggtaggaaccggccctactacacctactccgacgaggacgtacacgtaccctaaccgtaaacgtaacctttaccttttanaccgttaacgtaaccttaaaaggtaaccggaaaaccgtgaaaccgtacgaccggaacgtacgtaccgtcttacgttacttacgttacggcggtccgggtacggtacgtaacggaaacggtaacggtaacggggtcccgggtaccgtacggaccggtacgtacggtacggtaccgg

SEQ ID NO: 334360 - DNA, 610 bp, Homo sapiens
  misc_feature: GZ8MTXP02JM5UQ.25.35.D02.1.454.CMB.2.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (463)..(463): a, c, t, g, unknown or other
  misc_feature (463)..(463): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgtttggcattcacgtgggtcccnccaggcctccaggcaagggctgggagtggggtggcggtcagtagtggggtggatgggaagtatgactatttangcagtactccgtaggaacgggcccactccgaccctattcccnccgaaggnggccacgcctacccgaaagtaaccctacttttacnctacgactaaagttacgaaaccgtgacgtacgacgacgacgacggtctagtacttacgtacgtcggccgggtacgggtacgtacggaaacggacggtacggggtccggggaccgtacggtacggtcgacggtcgggtaccgtccggg

SEQ ID NO: 334361 - DNA, 607 bp, Homo sapiens
  misc_feature: GZ8MTXP02FN9DH.25.35.D02.1.454.CMB.2.raw
  modified_base (307)..(307): a, c, t, g, unknown or other
  misc_feature (307)..(307): n is a, c, g, or t
  modified_base (385)..(385): a, c, t, g, unknown or other
  misc_feature (385)..(385): n is a, c, g, or t
  modified_base (469)..(469): a, c, t, g, unknown or other
  misc_feature (469)..(469): n is a, c, g, or t
  modified_base (535)..(535): a, c, t, g, unknown or other
  misc_feature (535)..(535): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccgggaagtccctgagactctcctgtgcagtcgccgcgtccaccttccgtcgtttggctattcacgtcgggtcccnccaggctccaggccaagggctgggagtggggtggcggtcagtagtggggtgggatgggaagtaactgactagttttanggcaggtactccgtaggaaacggggcccactaccacgtatccgaccgaggacggcaggcctaccaaagtaacctacctttttanctacgtactaagttacgaaaccgtgaacgtacgtacggaacgacgacgtctacgtacttacgtcgnggccggtcgggtactacggaaacgacggtacggggtccggacctacggtacggcgaggtccggacggtccgg

SEQ ID NO: 334362 - DNA, 616 bp, Homo sapiens
  misc_feature: GZ8MTXP02I2NOL.25.35.D02.1.454.CMB.2.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (381)..(381): a, c, t, g, unknown or other
  misc_feature (381)..(381): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaagtccctgacgactctctgtgcagtcgtccgcgtccaccttccgtcgttttggctattcacgtcgggtcccncaggctccgaggcaagggctgggagtgggtggcgtnagtagtggtgggataggaagtatgactattttngactagtacctccggtaggaacggggtcccactccaccctatcctcccaggacggccacgacctaccaaagaaccttacccgttttatccgttacgtactaaacgttaggaaaacccgtggaactacgtacgaacgacaacggcttcgttactagttaccgtggaccggtcggggtactacggaacgtaacggaacggggtccggggtccgtacgtacggctaggtcgggaccgg

SEQ ID NO: 334363 - DNA, 613 bp, Homo sapiens
  misc_feature: GZ8MTXP02F9JCS.25.35.D02.1.454.CMB.2.raw
  modified_base (380)..(380): a, c, t, g, unknown or other
  misc_feature (380)..(380): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaagtccctgagactctcctgtgcagtgtccgcgtccaccttccgtcgttttggctattcactgggtcccgccaggctccgaggcaagggctggagtggggtggcggtcagtagtggtgggatggaaataatgactattttngacagacctccggtagaaacggggccactcaccatcctccaaggagcagccgtaccaaanaacctacctttttaancgtagactaagttaacgaaaaccgtgaacgacgtacggaacgacgacgtctacgttacttacgttacgcggtccgggtacgggtactaacggaaacggtaacggaaccgggggtacccgggaccggtaccgtacggaccgtacggtaccgggaccgg

SEQ ID NO: 334364 - DNA, 633 bp, Homo sapiens
  misc_feature: GZ8MTXP02G1XZS.25.35.D02.1.454.CMB.2.raw
  modified_base (393)..(393): a, c, t, g, unknown or other
  misc_feature (393)..(393): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgcagatgcaactggcggaggtcggggggaggcggtggtccgaggccgggggaagtcccgtgagactctcctgtgcagtcgtccgcgtccacccttccgtcgtttggctattcactgtcgtccgcaggcctccgaggcgaagggactggaggtgggtggcggtcatagtggtgggatggaaagtatcgacttagtttttagngacacggtaccgttccggtagggaaaccgggtcccgacctaccaccgtactctacccgaggacggccacgccctaaccgaaacgtaaccttaccttttaagctacgaacttaacgttacggaaaacgtgaacgtactacgaacgtacgacgtactgtacttactaccgtggccgggtacggtactacggaacgaacgtcggggttcccgggacttcggaacggctaacggcggaaccggg

SEQ ID NO: 334365 - DNA, 705 bp, Homo sapiens
  misc_feature: GZ8MTXP02FXVQS.25.35.D02.1.454.CMB.2.raw
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
  modified_base (526)..(526): a, c, t, g, unknown or other
  misc_feature (526)..(526): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtgggcggaggtcggggggaggcgtggtccgaggccggggaagtccctgacgctctcctgtgcagtgtccgcgtccnccttccgtcgtttgctattccgacgtcgggtcccncgaggctccgaggccgaaggggctgggaggtggggtgggtcggtcagtagtggggtaggagtgggaaagttaatgacttaatttttgcgactaaggtaccgttccgggtaggaaacggggccccgtaaatcccgaaccctataccctacccgaaggacggccgaacggtacccttaaccgaaaaacgtaaccctttaaacccttttttanaccgttaacggtactaaaacgtttaaccggaaaaacccgttgaacgtaccgtaccggaaactaccgacggtactcgttacttacgttacgtcgggaccggtacgggggttctaacggaaacgtaaccggtaagggggtcccgggtaccgtacgtacgggacaacggttcgggaacccgg

SEQ ID NO: 334366 - DNA, 595 bp, Homo sapiens
  misc_feature: GZ8MTXP02H8BSG.25.35.D02.1.454.CMB.2.raw
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (458)..(458): a, c, t, g, unknown or other
  misc_feature (458)..(458): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcgggaggtcggggggaggcggtgggtccaggccggggaagtccctgagactctcctgtgcagtgtccgcgtccaccttccgtcgtttgctattcactgggtccnccaggctccgaggcaagggctgggagtggggtggcggtcatagtggtgggataggaagtatgctattttngtacagtacctccgtaggaacggcccgactcacactctccgagacggcacgcctaccgaagtaaacctaccttttancctagactaaagttacgaaaaccgtgaacgtactacgacgacacggtctagtactagttaccgtgaccgggtcggggtactacggaaacgaacggtcgggtccggggccgttacgtaccggctacgtacggacccgg

SEQ ID NO: 334367 - DNA, 559 bp, Homo sapiens
  misc_feature: GZ8MTXP02I5D8S.25.35.D02.1.454.CMB.2.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtgtttggcattcactgggtccnccaggctccaggcaagggctggagtgggtgccggtanagtgtggtcggataggaatatgacttatttgngcagactcgaggacggccactcacatcgacgagacgcancacaagtacttactttanctagactaagtacgaaaccgtgacgactacgacacgtacgtcttagtacctacgtacgcggaccggtcgggttacaacggaacgaacggcggggtcccgggacctacggtacggcgtacgtacggggaccg

SEQ ID NO: 334368 - DNA, 666 bp, Homo sapiens
  misc_feature: GZ8MTXP02IJV1Q.25.35.D02.1.454.CMB.2.raw
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (471)..(471): a, c, t, g, unknown or other
  misc_feature (471)..(471): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcgggaggtcggggggagcgtggtccaggccggggaatccctgagactctcctgtgcagtgtccgcgtcctaccttccgtcgtttggctattcacgtcgggtccnccaggcctccgaggccgaaggggtactgggaggtggggtggcggtnagtagtgggtggatggaatatgacttattttngcgagtacctccggtagggaacgggcccaactcacctatccnccgagcggcagacctaccgaaacgtaaccttaccttttanctacgacctaaagttaccgaaaaccgtgaacgtacgtaccggaacgtacgtaccggtcttacggttaccttacgtttacggcgggtacccgggtacgggggttacctaaaggggaaaccggtaaccggtccgggggttcccgggggtacccgttacgggtaaccgggacgttaacgggtcggggtaaccccgggg

SEQ ID NO: 334369 - DNA, 581 bp, Homo sapiens
  misc_feature: GZ8MTXP02G2HQJ.25.35.D02.1.454.CMB.2.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
  modified_base (439)..(439): a, c, t, g, unknown or other
  misc_feature (439)..(439): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggatccctgagactctcctgtgcagtcgtccgcgtccaccttccgtcgtttggctattcncgtgggtccncaggcctccgaggcaagggctggagtgggtgcggtcagtagtggtgggatggaatatgactatttncgcagtaccgtcgtggaacggccactcaccctatcctacagacggcagctacaacgtacttacctttanactagaactaagtacgaaacgtgacgtaccgtacgacgacgacgtctacgttacttacgtacgtcggaccggtacgggtacgaacggaacggtaacggtcgggggtccggtaccgtacggacggacgtacgggtacggaccg

SEQ ID NO: 334370 - DNA, 633 bp, Homo sapiens
  misc_feature: GZ8MTXP02H5JKD.25.35.D02.1.454.CMB.2.raw
  modified_base (265)..(265): a, c, t, g, unknown or other
  misc_feature (265)..(265): n is a, c, g, or t
  modified_base (496)..(496): a, c, t, g, unknown or other
  misc_feature (496)..(496): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactgggcgggaggtcggggggaggcgtgggtccaggccggggaagtccctgagactctcctgngcagtgtccgcgtccaccttccgtcgtttggctattcacgtcgggtccgccaggcctccgaggcaagggcgtgggagtggggtggcggtcagtagtgggtgggatgggaaataacgtgacgtatttttagcgtcagtaccgtccggttaggaaacgggcccgaactccaacctattcccgacccgaggaacggccaaggccctaaccgtaaagaacctacccgtttttaanctagtaactaacgttacgaaaccgtgacgacgtacgacgacgacgtctcgtactacgttcgcggcgggtacgggtacaacggtaacggacggtcggggtccgggtaccgtacggtacggacgtacggtacgggaccg

SEQ ID NO: 334371 - DNA, 614 bp, Homo sapiens
  misc_feature: GZ8MTXP02FOM4L.25.35.D02.1.454.CMB.2.raw
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
  modified_base (467)..(467): a, c, t, g, unknown or other
  misc_feature (467)..(467): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgcgtccaccttccgtcgtttggctattcactggtccnccaggctccaggcaagggctggagtggggtggcggtcagtagtgggtagggatggaagtaatggactaatttttagngacagtaccgtcggtaggaacgggccactaccacctactcctacgagacgacacgacctaaccaaacgtaaccttacctttancctagactaaagttacggaaaacgtgaacgactacgaacgacgacggtcttacgtacttacttacgtcggcgggtacggggttacgaaggaaacggaacggtcggggtccggggtaccgtacggtacggacgtacggtacgggaccg

SEQ ID NO: 334372 - DNA, 731 bp, Homo sapiens
  misc_feature: GZ8MTXP02JS1SI.25.35.D02.1.454.CMB.2.raw
  modified_base (313)..(313): a, c, t, g, unknown or other
  misc_feature (313)..(313): n is a, c, g, or t
  modified_base (392)..(392): a, c, t, g, unknown or other
  misc_feature (392)..(392): n is a, c, g, or t
  modified_base (627)..(627): a, c, t, g, unknown or other
  misc_feature (627)..(627): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggaggcggtggtccgaggccggggaagtccctgagactctcctgtgcagtcgtccgcgtccaccttccgtcgtttgctattcacgtcggtccncaggcctccgaggcaagggctgggaggtggggtggcggtcagtagtgggtggagtggaaagtatggtacttattttagngactaaggtacccgttccgggtaagggaaaccgggggtcccctaaccttacccgaaacccgtaacttcccgaaccccgaaggaaccgggccaaacggcccttaaaccccgaaaagtaaaccctttaccctttttaagccgtaacgtaacctaaaagtttaaccggaaaaacccgttgaaacgtaaccgttccggaaaccgacgtaccgggtcttacggtaccttaacgttaccgngggacccgggtcgggggttaactagggaaaaccggtaacggtacgggggtcccggggaccgttaccggaaccgggcgaacggttccggggacccggtcccgggg

SEQ ID NO: 334373 - DNA, 612 bp, Homo sapiens
  misc_feature: GZ8MTXP02GEU07.25.35.D02.1.454.CMB.2.raw
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
  modified_base (448)..(448): a, c, t, g, unknown or other
  misc_feature (448)..(448): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccgggaatccctgagactctcctgtgcagtgtccgcgtccaccttccgtcgttttgctattcacgtgggtcccncaggcctccgaggcaagggctggagtggggtcggcgtcagtagtggtggatgggaataactgactattttgngacagtactccggtagaaacgggccctactcaccntcctcgagacgcagctaccaaagtacctacctttnctagactaagttacggaaaaccgtgaacgacctacggaacgacgaaccggtcttacgtaccttaagtttaccggcggtaccgggtacggggtactaacgggaaacggtaacggtaacggggtcccggggtaccgtaccggtacggacgtacggtacgggtaccg

SEQ ID NO: 334374 - DNA, 667 bp, Homo sapiens
  misc_feature: GZ8MTXP02I9CMS.25.35.D02.1.454.CMB.2.raw
  modified_base (400)..(400): a, c, t, g, unknown or other
  misc_feature (400)..(400): n is a, c, g, or t
  modified_base (488)..(488): a, c, t, g, unknown or other
  misc_feature (488)..(488): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagaggtgtccagttgtcagatcgcaacgtggcggaggtcgggggagcgtggtccgaggccggggaatcccgtgacgctctcgtgtgcagtcgtccgcgtccaccgtttccgtcgttttggctagttccacgtcgggtccgcaggtcctaccgaggacaaggggctgggaggttgggtggcggtcagtagtggagggataggaatagtgtactattttgngactacggtcctacggtaggaaccgggccacttaccgacctagtccacgacggagccagtaccctacgaaacgtaaccttaccgtttnaccgttcaattaacgttacgaaaaccgtcgactaccgtcgaccgacgtacgtctacgttacttacggtaccgtggacccggtacggggttacaacgggaaaccggtaaaccggtcgggggtaacccgggggtcccgttacggtaaaaccgtccggtaaccggttacgggaaccccgggg

SEQ ID NO: 334375 - DNA, 655 bp, Homo sapiens
  misc_feature: GZ8MTXP02F95TI.25.35.D02.1.454.CMB.2.raw
  modified_base (346)..(346): a, c, t, g, unknown or other
  misc_feature (346)..(346): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccagccgggaatccctgagactctcctgtgcagtgtccgcgtccaccttccgtcgtttggcattcacgtggtccgccaggcctccgaggccaaggggactgggagtggggtggcggtanagtaggtgggtggagtaggaaagtatgtacttattttagcgactagtaccgtccggtagggaaccgggcccgtaacctccaacctacgtcctaccgaagacgactaacgtacctaaccgaaaacgtaaccttaaccttttaatccgtagtaactaaacgttaaacggaaaaccgtgaacgaccgtacgaacgaccgacggtacttacgtacttacgttacggtcggtccgggtacgggttacgaacggaaacggaaccggtcgggggtcccggggtaccgtacggtaccggacgtacggtaccggacgg

SEQ ID NO: 334376 - DNA, 580 bp, Homo sapiens
  misc_feature: GZ8MTXP02JN28D.25.35.D02.1.454.CMB.2.raw
  modified_base (308)..(308): a, c, t, g, unknown or other
  misc_feature (308)..(308): n is a, c, g, or t
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccagccggggaagtccctgagactctcctgtgcagtgtccgcgtccaccttccgtcgttttggcattcacgtggggtccnccaggcctccgaggccaaggggctgggaggtggggtggcggtcagtagtggtcgggatggaagtaatgactatttgngcagactcgtagaaggccactcacatcnccagagcagctacaagactacctttanctnactaagtacgaaacgtgacgactacgacgacgtacgtcttacgtacttacgttacgcggtacgggtacgggtacaacggaacggaacggtaacgggggtacccgggaccgtacggacggtacgacggtacggaccgg

SEQ ID NO: 334377 - DNA, 664 bp, Homo sapiens
  misc_feature: GZ8MTXP02JKBCE.25.35.D02.1.454.CMB.2.raw
  modified_base (314)..(314): a, c, t, g, unknown or other
  misc_feature (314)..(314): n is a, c, g, or t
  modified_base (394)..(394): a, c, t, g, unknown or other
  misc_feature (394)..(394): n is a, c, g, or t
  modified_base (484)..(484): a, c, t, g, unknown or other
  misc_feature (484)..(484): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctgttgcttcttttaagaggtgtccagtgtcagatgcaactggcgggaggtcgggggaggcgtggtccgaggccggggaatccctgacgactctccgtgtgcagtcgtccgcgtccaccttcgtcgtttggctattcacgtcgggtcccnccaggcctccgaggccgaaggggctgggaggtggggtggcggtcagtagtgggtggataggaaagtatgacttatttagngactaggtacctcggtagggaacgggcccactccaacctattccaccgagacggaccacgaccctaaccaaacgaaccctttacctttanacgtacgtaactaaacgtttacgggaaaaccgtggaacgacccgtaacggacgaccgacgggtcttcgttaacctagttaccgcggtccggggtacggggtactaagggaaacgtaaaccgggtcgggggtaccccggggtaccgtacggtaaccgggcgaacggtccggggtaacccgg

SEQ ID NO: 334378 - DNA, 756 bp, Homo sapiens
  misc_feature: GZ8MTXP02G312V.25.35.D02.1.454.CMB.2.raw
  modified_base (312)..(312): a, c, t, g, unknown or other
  misc_feature (312)..(312): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggagcggtggtccgaggccggggaagtccctgacgactctcctgtgcagtcgtccgcgtccaccttccgtcgtttgctattcacgtggtcccnccaggcctccgaggccaagggctgggaggtggggtggcggtnagtaggtgggtggggagtgggaaagttatgtacttaagtttttgngtacgtaggtaccgtccgggtaggaaaccgggcccgtaactccaacccgtacttccgaccgaaggacggtccgaacgtcccgtaacccgaaacgtaaaccctttaccctttttaatacccgtacgtaaccgtaaacgtttaaccggaaaaaacccggtcgtaaacggtaacccgtaccggaaaccggaacccgtaaccggggtaccttacgggtttacccttaagtttacccggtcggtaccggggtacccgggggttaactacgggaaaaccggtaaaccggggtccgggggttacccgggggtacccgttaccgggtaaccggggaccgtacggggtaccggggaacccccgggg

SEQ ID NO: 334379 - DNA, 639 bp, Homo sapiens
  misc_feature: GZ8MTXP02JY676.25.35.D02.1.454.CMB.2.raw
  modified_base (304)..(304): a, c, t, g, unknown or other
  misc_feature (304)..(304): n is a, c, g, or t
tcagactgtacagtcacgaccggtgctcgatttagcacacgatagttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacaccagcaacggcccccaaatcatctatttangatgtcagtcatccggcctgtggtagtttcgtggtcgtccttctcgtggctcgaagtctcgggaccaacgtccggaccctcccgtcgaaccctactccgtccggggtccctaccgacggtccgtaggacgggaccggtacgggtaccttaacgtttactttaacgtttcgtacttaacttttcaacttaaccgaagtaacgaaccaaacccgtaacgtacggtacgttgggttacggttacgggacgggtacgggtaaccgtaggtccggtaccgtccgttaccgacacgacccgaaggccctaccgccccgttacggcctaccgtcgttccccg

SEQ ID NO: 334380 - DNA, 627 bp, Homo sapiens
  misc_feature: GZ8MTXP02IVHUG.25.35.D02.1.454.CMB.2.raw
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
  modified_base (461)..(461): a, c, t, g, unknown or other
  misc_feature (461)..(461): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaaggaggtgtccagtgtcagatgcaacgtggcggaggtcgggggagcgtggtccaggccggggaagtccctgacgctctcctgtgcagtcgtccgcgtccaccttccgtcgtttgctattcacgtcgggtcccnccaggcctccgaggccaaggggctgggaggtgggtggccgtnagtagtgggtggatggaatagtgacttattttgngacagtacctccgtaggaacgggcccactccacctatcctacgagacgcagcctaccaaagaccttactttnctacgactattacggaaaacctgacgactcggaacgacgacggtctagttacttacgttacgcgggaccgggtaccggggttctaacggaaacggtaaaccggtcgggggtcccggggtacccgttaccggaaaccggtccgtaacggtacccggggaaccccggg

SEQ ID NO: 334381 - DNA, 602 bp, Homo sapiens
  misc_feature: GZ8MTXP02INU4Y.25.35.D02.1.454.CMB.2.raw
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagactgtacagtcacgaccggtgctcgatttagcacacgatagttgggtttggggagctctgggagaggagcccggcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcggtggtccgaggccgggggaagtccctgacgactctcctgtgcagtcgtcccgcgtcccacctttccgttcgtttggctattcacgtcgggtcccnccaggcctccgaggcgaagggctgggacggtggggtgcggtcagtagtgggtggatgggaatatgntattttangcagctcgtgacggccactcacatcncagngcagcacaagactacttanctagataagtacaaaccgtgacgactaccgacgacgacggtactcgtacttacgttacgtggccggtccggggtactacgggaaacgtaaccggtaccggggtccgggggtacctacggtacccgggagtaccggttacgggaacccgcccggggg

SEQ ID NO: 334382 - DNA, 646 bp, Homo sapiens
  misc_feature: GZ8MTXP02HM9KZ.25.35.D02.1.454.CMB.2.raw
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgattcgttggtgtcttatgacactgtctctggcaccagtttaccaaggaaacgccccagagtcatccttatgtatgtcaggtaagcggaccctcgacggggtcccctagaccgtcgtcttcgtcgttcgggtaccctaaatcgtcgggacaaaccgaccgggtcccctccctacggacccattcctccgttcgggcccttccgaagggtcctaggaggtatagggaggtctaggttatttaagtttagtttacggctttaggttacctattaagttcgagtacggtaacctaaaccgttacgttaagtttttcggtcggtttcgggaccgtacgggtaacggtacccgtaaacggttcgtaaccggtccgtcgggttcgaacccggaccgacgggtcccttccggtccccccgg

SEQ ID NO: 334383 - DNA, 586 bp, Homo sapiens
  misc_feature: GZ8MTXP02FYHQJ.25.35.D02.1.454.CMB.2.raw
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (373)..(373): a, c, t, g, unknown or other
  misc_feature (373)..(373): n is a, c, g, or t
  modified_base (438)..(438): a, c, t, g, unknown or other
  misc_feature (438)..(438): n is a, c, g, or t
  modified_base (503)..(503): a, c, t, g, unknown or other
  misc_feature (503)..(503): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtgtccgcgtccaccttccgtcgtttgcattcactggcccncaggctccaggcaagggctggagtgggnggcggttcatagtggtggatagggaaataagtgactattttanggcagacgtccgtaggaacgggccactcacagtcacgagagcagctacaaagaactaccttttanctagactaagtaacgaaaacgtgaacgtaccgacgaacgacgacggtctgtacttaacgttacgngggcgggtacgggtactaacggaaaacggacggtacggggtccgggtaccgtacgtacggacgtacggtacgggaccggccgg

SEQ ID NO: 334384 - DNA, 636 bp, Homo sapiens
  misc_feature: GZ8MTXP02J0K86.25.35.D02.1.454.CMB.2.raw
  modified_base (385)..(385): a, c, t, g, unknown or other
  misc_feature (385)..(385): n is a, c, g, or t
  modified_base (426)..(426): a, c, t, g, unknown or other
  misc_feature (426)..(426): n is a, c, g, or t
  modified_base (517)..(517): a, c, t, g, unknown or other
  misc_feature (517)..(517): n is a, c, g, or t
  modified_base (537)..(537): a, c, t, g, unknown or other
  misc_feature (537)..(537): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaagtcccgtgagactctcctgtgcagtgtccgcgtccaccttccgtcgtttgcattcacgtggtccgccaggcctccgaggccaaggggctgggaggtgggtggcggtcagtagtggggtggatagggaagtaatgactattttagngacaggtacctcggtagaacgggcccactccgaaccatccnccgaagacggcagccctaccaaagacccttacctttagcctaggactaaattacggaaaacccgtgaacgtaccgtacgacgacaccggtntcggtacttaacgttaccgngggccggtacgggggttacctaggaaaacggaccggtacgggggtcccggggtacccgtacggtacccgggactacggtaccgggaaccgtccccgggg

SEQ ID NO: 334385 - DNA, 661 bp, Homo sapiens
  misc_feature: GZ8MTXP02HJI6J.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcgggggaggcggtggtccggcggggaagtccctgagactctccgtgtgcagtcgtccgcgtccaccgttccgtcgtttggcattcacgtcggtccgccaggccgtccgaggcgaaggctgggaggtgggtggcggtcagtagtgggtgggagtagggaacttaagtgtactagttttagtcgcgtagtaccgttccgtagggaacggggaccctaacgtccaaaccgagttccctaccgaaagggcggactacgaccgttacccgaaaagtaaacccttacctttttaaacgcgttagaaccttaaagttacggaaaacccgtgaaccgactaccgacgaacgacggtactacgtactaacgtcgtcggacggtccgggggttactaggaaacgtaacggcgggggttaaccgggctcggtacgaacgcgacggtacggcccgg

SEQ ID NO: 334386 - DNA, 576 bp, Homo sapiens
  misc_feature: GZ8MTXP02HU033.25.35.D02.1.454.CMB.2.raw
  modified_base (242)..(242): a, c, t, g, unknown or other
  misc_feature (242)..(242): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcgttggngcttatgacactgtctctggcacctagtttacccaggaaaacgcccccagacgtcatccttatgatgtcaggaacgcggccctcgacggggtcctgactcgcttctcgtggtaccaaatccgtaggtacaacgaccggtccctccctgaccctacttctccgtgggtcctccgaggtctggacggagtcgaggctagtatttagttatttgcttagttcattagtgaccgaggtactaacgtacgttagttttgggtgtttcggcgtacgaacggtaccgtaacggttcgaccgtcgtcggtacacgtaccgaacggtccgtaccgttcccccg

SEQ ID NO: 334387 - DNA, 596 bp, Homo sapiens
  misc_feature: GZ8MTXP02H1LKF.25.35.D02.1.454.CMB.2.raw
  modified_base (399)..(399): a, c, t, g, unknown or other
  misc_feature (399)..(399): n is a, c, g, or t
  modified_base (477)..(477): a, c, t, g, unknown or other
  misc_feature (477)..(477): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggaggcgtggtccaggccggggaagtccctgacgactctcctgtgcagtcgtccgcgtcctaccttccgtcgtttggctattccacgtcgggtcccgccgacggctaccgaggacgaaggggactgggaggtggggtggcggtcagtagtgggtgggatagggaagtatgacttattttgngcacgactccggtggaacgggccgactcacccatcctaccgagacggacacgcctaaccgaacgaacttaccttttanactagactaaagtacgaaaaccgtgacgtactacgacgacgacgcttgtactattacgcgccggtacgggtacacgtaagacggtaagggtcggacgtcgtacggctaggtcggaccgg

SEQ ID NO: 334388 - DNA, 750 bp, Homo sapiens
  misc_feature: GZ8MTXP02IYJV8.25.35.D02.1.454.CMB.2.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcggtcaccatctcctgcactggaaccagccgtgacagttggncttataactatgtctcctgtcccaaacacacccagccaacggcccccaaatcatctatttangatgtcagtcactccggcccctntggtatttcgnggtccgtcttctactggcctacctaggtcctacgggtaccaaaccgttccgggcccttccccgagtaccccgtagttcccggttccgggggcctacccggtaacggggccgtacggggaaacgggtaccggtaacgggtaccctttaacgttttaagtttaccgttaggtaccttaacgtttttacaacggttaaaccaagggaaacctaccgaaaccctaaaacgttaggttaccgtttaggggttcggttaccgggggacccgggggtaaacgggtaaaccccgtaaaagggtttccggtacccggtttacccccgtaccggggttacccaaaccgggacccccgttaaaccgggggtccccttaaccccgggtacccccccggttcggggttaacccccttaccccgg

SEQ ID NO: 334389 - DNA, 563 bp, Homo sapiens
  misc_feature: GZ8MTXP02HR1SG.25.35.D02.1.454.CMB.2.raw
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (433)..(433): a, c, t, g, unknown or other
  misc_feature (433)..(433): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttccctcgttgcttcttttaagaggtgtccagtgtcagatgcaactggcggaggtcgggggagcgtggtccaggccggggaatccctgacgactctcctgtgcagtcgtccgcgtccaccttccgtcgttttggctattcacgtgggtccnccaggcctccgaggcaagggctgggagtggggngcggtcagtagtgggtggatggaagtatgctatttngcagactcgngaacgccatcacatctacagacgcagctacaagactactttanctagacaaattacgaaaacctgaacgactcgacgacgacggtctacgtacttagttacgcggacgggtcgggtactaggaacgaacgtcggggtacggggccttacgacggaccgtagtccggaacccgg

SEQ ID NO: 334390 - DNA, 628 bp, Homo sapiens
  misc_feature: GZ8MTXP02JONSA.25.35.D02.1.454.CMB.2.raw
  modified_base (267)..(267): a, c, t, g, unknown or other
  misc_feature (267)..(267): n is a, c, g, or t
  modified_base (327)..(327): a, c, t, g, unknown or other
  misc_feature (327)..(327): n is a, c, g, or t
  modified_base (557)..(557): a, c, t, g, unknown or other
  misc_feature (557)..(557): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggaggcggtggtccgaggccggggaatcccgtgacgacctctcctggngcagtcgtcccgccgtccctaccgttccgttcgtttggctagttccacgtcggggtcccnccgaggcctacccgaggaccgtaaggggactaggaggtttcggggtcttacgtttttaggtcggggctagtggaacgttggactaaggtagaaacgtaaacgccttagtcgacgtaagtacccgtccgtacggacggtcccgtcttccgtccactcctacagacacaacgaccgaagacgtacgttaccttagactaaagtacgaaacgcgagacgaccgacgacgacgntagtagtactacgtgtcgacgagacgccgagtgaaggcgtcggacgtacggcggacgtcggtacgtcgggg

SEQ ID NO: 334391 - DNA, 717 bp, Homo sapiens
  misc_feature: GZ8MTXP02IF1DG.25.35.D02.1.454.CMB.2.raw
  modified_base (260)..(260): a, c, t, g, unknown or other
  misc_feature (260)..(260): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggagtcgggggagcgtggtccaggccggggaatccctgagctctcctgtgcngtcgtccgccgtcctccgttccgttcgtttcgtctactcgtcgtcggtccgccgacgccgtccgacggacggaacggacggtggtagggtgggtcgggtcggtcgtagtaggtggtgggtagtaggtaagtaagtagtacgttaagtttagtacgtacgtacgtaccgtaccggtacggaacgggtacccgtacccgtacccgtaacctaccgtaccgtaccgacgacggaccgacgtaccgtaaccgtaaaccgtaaaccttaacctttacttacgtacgtaacgtaaacgtaaacgtaaaccgtaacgaacgtaacgtaccgaaccgaaccgtaccgtacgtacgttacgttacgttacgtacggtaccggtaccgggtacggtacggtaacggtaaccggtaaccgggtaccgggtaccggtaccggtaccggtacggtacggtacggtaccgg

SEQ ID NO: 334392 - DNA, 540 bp, Homo sapiens
  misc_feature: GZ8MTXP02GA1GE.25.35.D02.1.454.CMB.2.raw
  modified_base (376)..(376): a, c, t, g, unknown or other
  misc_feature (376)..(376): n is a, c, g, or t
  modified_base (433)..(433): a, c, t, g, unknown or other
  misc_feature (433)..(433): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttcgtcgtttggcattcactggtccgccagggctccgaggcaaggggactgggagtggggtggcggtcatagtggtggggatgggaagtaatgctattttngcagactccgtgaagggccgactcaccatctccagagcagctcaaagacacctttanctgactaatagaaaaccgtgagacctacgacgacacggctagtctatactgcggcggggtctacggaagaacgaagggtcggggcgtacgtacggcacgtggaccgg

SEQ ID NO: 334393 - DNA, 640 bp, Homo sapiens
  misc_feature: GZ8MTXP02FZ4A9.25.35.D02.1.454.CMB.2.raw
  modified_base (389)..(389): a, c, t, g, unknown or other
  misc_feature (389)..(389): n is a, c, g, or t
  modified_base (466)..(466): a, c, t, g, unknown or other
  misc_feature (466)..(466): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccgaggccggggaagtcccgtgagacctctcctgtgcagtgtccgcgtccaccttccgtcgtttggctattcacgtggtcccgccaggcctccgaggcaaggggctgggaggtggggtggcggtcagtagtgggtggatggaaagtatgacttattttgngctagtacctccggtaggaacggggcccactcacctatcctccgagacggcagcctaccaaaagaccttacctttancgtagactaacgttaacggaaaacccgttgaacgtacgtaccgaacgtaccgaacgggtctacggttactacgttacggtcggcgggtaccggggttactaacggaaacggtaaacgggtaaccgggttccgggggacctacgggtaaccggcgtaacggtcggggaaccccgg

SEQ ID NO: 334394 - DNA, 700 bp, Homo sapiens
  misc_feature: GZ8MTXP02IXQ1K.25.35.D02.1.454.CMB.2.raw
  modified_base (183)..(183): a, c, t, g, unknown or other
  misc_feature (183)..(183): n is a, c, g, or t
  modified_base (312)..(312): a, c, t, g, unknown or other
  misc_feature (312)..(312): n is a, c, g, or t
  modified_base (396)..(396): a, c, t, g, unknown or other
  misc_feature (396)..(396): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagnggtgtccagtgtcagatgcaactggcggaggtcgggggagcgtggtccgaggccggggatccctgagactctcctgtgcagtcgtccgcgtcctaccttccgtcgttttggctattcacgtcgggtccnccaggtcctccgaggaccgaaggggtacgtgggaggtggggtggcggtcagtagtggtggatggaagtatgtacttagttttgngtacgtagaccgttccgggtaggaacgggggccctaactccaaccctatccgtaccaaggacggacctacgacctaacccgaaacgtaaacctttaaccctttttaactccgtagtacctaaaagtttaacggaaaacccgttagaacgtaccgttaccggaaaacgtactaagtcggtacttaggttaccttaaacgtttacggtacgggtcggtacccgggggttactaacgggaaaacggtaacccggtacgggggtacccgggttacccggtacggttaacggccgtaacggttccgggg

SEQ ID NO: 334395 - DNA, 754 bp, Homo sapiens
  misc_feature: GZ8MTXP02HZV1K.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggtttttcctcgttgcttcttttaagaggtgtccagtgtcagatgcaactgggcgggagggtcggggggaggcggtgggtccgagggccggggaagtcccgtgacgactctcctgtcgcagtcgtccgcgtaccctccttccgtcgtttgctattcgacgtcgggtccgccgaggtcctccgaggacgaaggggacgtgggtaggtggggtggcggtagtagtaggtgggtggggtaagtagggaaagttaacgtggtacttaagtttttgcggtactaacggtaccgtaccggtagggaaaccgggtacccaaccgtccaaaccctacgttcccgtaaccgacgggaaggccaacggtaacccttaaccccgaaaagtaaccctttaaccgtttttacgccttaggtaaacccttaaaaggttaacccggaaaaccggttagtaaaccgaaccgttaccggaaccgtaaccgtaaccgggtcttaacggttaccttaacgtttaccggtcggaccggggttacggggtacaaagggaaacggtaacgggtccggggtacccggacggttacgacgggactacggtaccgggcccgg

SEQ ID NO: 334396 - DNA, 582 bp, Homo sapiens
  misc_feature: GZ8MTXP02I1IVV.25.35.D02.1.454.CMB.2.raw
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (374)..(374): a, c, t, g, unknown or other
  misc_feature (374)..(374): n is a, c, g, or t
  modified_base (457)..(457): a, c, t, g, unknown or other
  misc_feature (457)..(457): n is a, c, g, or t
  modified_base (547)..(547): a, c, t, g, unknown or other
  misc_feature (547)..(547): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtgtccgcgtccaccttccgtcgtttggctatcacgtgggtccncaggctccgaggcaagggctggagtgggtgcgtnagtagtggtgggatgggaaatagtgctattttgngcagtacctccggtaggaaacgggcccactcaaccctagtcctaccgaggacgctacgacctaccaaagtacttaccttttanctagactaagttacgaaaaccgtgaactactacgaacgacgacggtctgtactattacgcggacggtacgggtctaacggaacgaacggngggtaccggggctacggtacggcaggtcggaccgg

SEQ ID NO: 334397 - DNA, 663 bp, Homo sapiens
  misc_feature: GZ8MTXP02G8EDU.25.35.D02.1.454.CMB.2.raw
  modified_base (308)..(308): a, c, t, g, unknown or other
  misc_feature (308)..(308): n is a, c, g, or t
  modified_base (396)..(396): a, c, t, g, unknown or other
  misc_feature (396)..(396): n is a, c, g, or t
  modified_base (491)..(491): a, c, t, g, unknown or other
  misc_feature (491)..(491): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcgggggagcgtggtccaggccggggaagtccctgagactctcctgtgcagtcgtccgcgtccaccttccgtcgtttgctattcactcgggtccnccaggctccgaggccgaaagggctgggagtggggtggcggttcagtagtggggtagggatgggaaagtaacgtgtacttatttttagngacaaggtaccgtccggtaggaaacggggcccactcgaaccctatccacccgagacggcctaggacctacccgaaagtaaccttaccctttttancttcgaacctaagttaccggaaaacccgtgaaacgtacgtaccgaacgaccgacggtctagtacttacgttacgtcggaccgggtacgggtacctagggaaacggtaaacgtcgggggttccccggggtacccgtttaacggccggaccgtaggttacggggaacccccggg

SEQ ID NO: 334398 - DNA, 588 bp, Homo sapiens
  misc_feature: GZ8MTXP02JB18Z.25.35.D02.1.454.CMB.2.raw
  modified_base (344)..(344): a, c, t, g, unknown or other
  misc_feature (344)..(344): n is a, c, g, or t
  modified_base (391)..(391): a, c, t, g, unknown or other
  misc_feature (391)..(391): n is a, c, g, or t
  modified_base (470)..(470): a, c, t, g, unknown or other
  misc_feature (470)..(470): n is a, c, g, or t
  modified_base (492)..(492): a, c, t, g, unknown or other
  misc_feature (492)..(492): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccattgtcagatgcaactggcggagtcgggggagcgtggtccaggccggggaagtccctgagactctcctgtgcagtgtccgcgtcccaccgttccgtcgttttggcacttcacgtcgggtccgccaggctccgagggcaaggggctgggagtggggnggcggtcatagtgggtacgggatggggaaagtatggactaatttttntggacctaggaccgtccggtaggaaacgggggtcccaactcaaccatctccgagacgcagcctacaagactacctttanctagctaattacgaaaaccgtnagactcgaacgacacgggactgtactatacgcggacgtcggggtctacggacgaaaccggtgggtccggggcctacggtacgcctagtcgggaccg

SEQ ID NO: 334399 - DNA, 614 bp, Homo sapiens
  misc_feature: GZ8MTXP02GGL4I.25.35.D02.1.454.CMB.2.raw
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
  modified_base (512)..(512): a, c, t, g, unknown or other
  misc_feature (512)..(512): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccgaggccggggaatccctgagactctcctgtgcagtcgtccgcgtccaccttccgtcgtttggctattcactgggtccnccaggcctccgaggcgaagggctggaggtgggtggcgtcatagtgggtggatggaaagtatgactattttgngctagactccgtagaacggggcccactcaaccctntcctccaggacggccaaggtccaccaaagtaaccttaccgttttanacctagtactaaatttacggaaaaccgtgacgacgttcgaacgacgaccggtnttcgtactacgttacgtcggtccgggtacggggtctacgggaacgtaacggaacggggttacccggggccgttaccggaacggccgtaggtacggacccggg

SEQ ID NO: 334400 - DNA, 717 bp, Homo sapiens
  misc_feature: GZ8MTXP02HN7GO.25.35.D02.1.454.CMB.2.raw
  modified_base (405)..(405): a, c, t, g, unknown or other
  misc_feature (405)..(405): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcggggggagcgtggtccaggccggggaatccctgagactctcctgtgcagtcgtccgcgtccaccttccggtcgtttggctattcacgtcgggtccgccaggcctccgaggcgaaaggggactgggagtggggtggcggtcagtagtgggtaggggaatagggaaagttaagtcgtacgttaatttttgngacacgtaccgtccgggtaaggaaaccgggaccctaactacccaaccctacgtacccgtacccgaggacggaccaacgtaccctaaaccgaaaacgtaaaccctttaaccttttacgtacgtacgtaacctaaagttaaacggaaaaccgtgaacgtaaccgtacggaaccgtaaccgtacggtacgttacgtacgttacgttacggtcggaccggggtacggggtactaacgggaaaacggtaaaccggggtccgggggtacccggggtaccgttaccgggtaaccggtacggtacggtaccgggaccggg

SEQ ID NO: 334401 - DNA, 632 bp, Homo sapiens
  misc_feature: GZ8MTXP02HSX0H.25.35.D02.1.454.CMB.2.raw
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
  modified_base (487)..(487): a, c, t, g, unknown or other
  misc_feature (487)..(487): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtcgtccgcgtccaccgttccgtcgttttggctacttcacgtgggtcccnccaggcctccgaggcaagggctggagtggggtggcggtcagtagtggtgggatgggaagtatgacttattttgngacagtacgttccgtagggaacgggtcccgacttccaacccgtatcctacccgaggtacggctacggacctacccgaaaagtaacccttaccctttttaanccgttagacctaaagttacggaaaaccgtgacggtactacggacgacgacggtctacgtcttagttacgtggaccggtcggggtactaggaaacggacgtcggggtaccggggccgttacgaacgggtccaaggtcgggacccgg

SEQ ID NO: 334402 - DNA, 597 bp, Homo sapiens
  misc_feature: GZ8MTXP02GEF1F.25.35.D02.1.454.CMB.2.raw
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatccctgagactctcctgtgcagtcgtccgcgtccaccttccgtcgttttggctattcactgggtccnccaggcctccgaggcaagggctggagtgggtggcggtnagtagtggtggatggaagtatgactagttttngcagtacctcgtagaaacgggccactcgaccattcaccagacgcanccgtaccaaagtacctaccttttanactagtactaagtaacggaaaccgtgaacgaccgtacgaacgacgtacgtctacgtacttacgttacgcggtaccggtacgggtacgtacggaaacggtacggtaacgggggtccggaccgttacggtacggacgtacggtacgggaccg

SEQ ID NO: 334403 - DNA, 826 bp, Homo sapiens
  misc_feature: GZ8MTXP02GPDH1.25.35.D02.1.454.CMB.2.raw
  modified_base (320)..(320): a, c, t, g, unknown or other
  misc_feature (320)..(320): n is a, c, g, or t
  modified_base (373)..(373): a, c, t, g, unknown or other
  misc_feature (373)..(373): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccgaggccgggaatcccgtgacgactctcctgtgcagtcgtccgccgtccctaccgttccgtcgttttagctattcgacgtcgggtcccnccaggcctaccgaggaccgaaggggtaccgtggaggtggggtcggtccggtanagtaggttggggtaggggtaatagggaaagttaacgtggtacttaagtttttagcgaccgtaacggtaccgttccgggaagggaaaccggggacccctaacttaccgaaccctagttacccgtaacccgaagggacggacctaacggaccccttaaacccgaaaacggttaaaccctttaaaccccgttttttaaacgaccgttaacgtaaaccgttaaaacggtttaaaacccgggaaaacccggttacggtaaaccgtaaccgtaacccggaaaccggtaccggtaccgggttacgtttaacgtttaaccgttaaacggtttacggtaccggggtaccggggttaaccggggttactaaaacggggtaaaccggtaaccggggtaaccgggggttacccggggtaaccgttaccgggaaccgggtacgtaccggggtaccgggtacccggg

SEQ ID NO: 334404 - DNA, 648 bp, Homo sapiens
  misc_feature: GZ8MTXP02HWI3F.25.35.D02.1.454.CMB.2.raw
  modified_base (307)..(307): a, c, t, g, unknown or other
  misc_feature (307)..(307): n is a, c, g, or t
  modified_base (385)..(385): a, c, t, g, unknown or other
  misc_feature (385)..(385): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgctccaccttccgtcgtttggctattcactgggtccnccaggctccgaggcaagggcgtggagtggggtggcggtcagtagtggtgggatagggaagtaatgtactatttttagngtacagtaccgttccgtaggaaacgggcccgacgtcaacccgatcctaccgaggacggccagtcctaaccgaaacgtaaaccttacctttttatccttaggtaactaaagtttaacggaaaacccgttgaacgacgtaccgaacgaccgacgggtcttacggttactaacgtttacgtcggtcgggtacggggttctacggaacggtaacggaacggggtccgggggtacccgtacgtacggaccgacggttacgggacccgg

SEQ ID NO: 334405 - DNA, 765 bp, Homo sapiens
  misc_feature: GZ8MTXP02H0SXY.25.35.D02.1.454.CMB.2.raw
  modified_base (259)..(259): a, c, t, g, unknown or other
  misc_feature (259)..(259): n is a, c, g, or t
  modified_base (442)..(442): a, c, t, g, unknown or other
  misc_feature (442)..(442): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtggtccaggccgggaagtccctgacgctctcctgngcagtcgtcccgcgtccctaccgttccgtcgttttggctacgttccgacgtcgggtccccgaccgacgggtcctccgaagggacccgaaaaggggtccgttaggggagggttggggtcgggccggtactaagtaggtggggtaggggattaggggtaaagtaagttggtacttaatttttagngtacgtaacgtaccgttaccgggtaggaaacgggcccgaacttccaacccgtactcccgtaccgaaggacggccacggtaccctaaaccgaaacgtaaacctttaaccctttttacgaccgttacgtaaccttaaaacgttaaccggaaaacccgttgaaaccgtaaccgtacggaaaccgtaccgtaacgggtcttacgttacgttaacgttaccgtacggtaccgggtacgggtttaccgaaggtaaaccggaacggtaacgggggtccggggttaacccgtacggttaaccggacggttacggtaccggggtaacccggg

SEQ ID NO: 334406 - DNA, 865 bp, Homo sapiens
  misc_feature: GZ8MTXP02IL4Y6.25.35.D02.1.454.CMB.2.raw
  modified_base (151)..(151): a, c, t, g, unknown or other
  misc_feature (151)..(151): n is a, c, g, or t
  modified_base (246)..(246): a, c, t, g, unknown or other
  misc_feature (246)..(246): n is a, c, g, or t
tcagactgtacagtcacgaccggtgctcgatttagcacacgatagttgggtttgggggggtctcaggaggcagcactctcgggacgtctccaccatggcctgggctctgctcctcctcagccctcctcactcagggcacaggatcccgggntcagtctgccctgactcagcctcgctcagtgtccggtctcctggacagtcagtcaccatctcctgcacgtaggaaccagaagtgattcgttggtntcttatcgactactgtcctacgtcggacctaccgttaaccgtttaaccccgaaaggtaaaccccgacccccgaaggtaccgtactaacctttacctttaacgtagtagttacggtacgtaaacgggtaacggtccccggtaccccgtacgggtacccggggttacccgtacgtaacccgttccgttaccgtttccgtccgggttaccggttaaaccctaaacgttccggtacggtaaccaaaacccggtccccggtacccccttcccgtaaccgtaacccgtaccgttccgtacccgggttacggccccgttaccggtaacgggtacccgttaggggaaaacgtgggttacgggacggggttaccttaaagggtttaaactttttaagttaacggtttcgttaacccgtttggtttaaccgtaattaccggtacgtaacggtaacggtaaccttaaaacgttacgttttaaggttttcgggtacgggtttacccgggcggtaacccgggtaaacgggttacccgtttaaacggttccggttaccccgggttaacggttccgggtaccgtaaccccgggtaaacccggtacggttacccgtacccccggtttacccccgg

SEQ ID NO: 334407 - DNA, 677 bp, Homo sapiens
  misc_feature: GZ8MTXP02ILW94.25.35.D02.1.454.CMB.2.raw
  modified_base (254)..(254): a, c, t, g, unknown or other
  misc_feature (254)..(254): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
  modified_base (504)..(504): a, c, t, g, unknown or other
  misc_feature (504)..(504): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcgggaggtcgggggaggcggtggtccgaggccggggaagtcccgngacgctctcctgtgctagtcgtccgcgtcccaccgttccgtcgtttgctattccgacgtcggtcccgccgaggcctccgaggccgaagggactggagtgggtgcggtcagtagtgggnggagtaggaagtatcgtacttaagttttgngactaacgtaccgttccgggtaggaaacgggtcccaacgtccaaccgattcccgacgaaggcgacaacgtcctaaacccaaagtaacccttaccgttttacncgttaacgaccgtaaagtttaaccggaaaaccgtgtaacgaccgtacgaccggtactacgggtactacgtttaacttacgttacggtcggtaacgggtcggggttacaagggaaacgtaccggtaacgggggtccgggtaccgttaccggacggcctagggtaccggcccggg

SEQ ID NO: 334408 - DNA, 742 bp, Homo sapiens
  misc_feature: GZ8MTXP02ITZCL.25.35.D02.1.454.CMB.2.raw
tcagactgtacagtcacgaccggtgctcgatttagcacacgatagttgggtttgggggggtctcaggaggcagcactctcgggacgtctccaccatggcctgggctctgctcctcctcagcctcctcactcagggcacagggtcctgggcccagtctgccctgactcagcctgcctccgtgtctgggactcctggacagtcggtcaccatctcctgcactggaaccagccgtgactattggtgcttaataactatgtctctgtccaacacaccagcaacgccccaaatcatcatttatgatgtcagtcatccggccctcgtggtacgtttcgtggtcccgtctttcctcgtcggtccttaccgaagttccgtcgggtacctaaacccgttcccgggtcccccttccccgtacgtaaccccctacgttcccggttacccgggggtcccttcccggaaggggtcccgttagggaacggggtaaccgggaacgggttacctttaaacctttagtttaacgtttcgtaccttaattttcctaaacttaaccgaaggaacgaacctaacccgaaacgtacgttccgttaggggttcggttaccggggacggggtaaacgggggtaacccgtaaaacgggttttcggaaccccggtttccggtcccggttaccgtaaaccggtcccccgaaaacggggtcccgttaccccggacccccccgtttacgggtccctaaccctttccccgg

SEQ ID NO: 334409 - DNA, 631 bp, Homo sapiens
  misc_feature: GZ8MTXP02JNCZH.25.35.D02.1.454.CMB.2.raw
  modified_base (363)..(363): a, c, t, g, unknown or other
  misc_feature (363)..(363): n is a, c, g, or t
  modified_base (449)..(449): a, c, t, g, unknown or other
  misc_feature (449)..(449): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctctttaagaggtgtccagtgtcagatgcaactggcggagtcgggggagcgtggtccagccgggaatccctgagactctcctgtgcagtgtccgcgtccacttccgtcgtttgcattcactggtccgcaggctccaggcaaggctggagtgggtgcgtcatagtggtaggatgggaataagtggctattttanggacagctacggtgaaacgggcccgaactcaaccctatccgtaccaaggacggcacggtcctaccgaaagtaacctaccttttaanctagacctaaagttcggaaaaaccgtgtacggaaccttacggaaccgtaacgaccgggacctaggttacccttaagttacggtacggaccgggtcgggggttaacctagggaaacgtaaaaccgggtaacggggtcgggggaccccgttacggaaccgggtcgacgttacgggggaacccgg

SEQ ID NO: 334410 - DNA, 613 bp, Homo sapiens
  misc_feature: GZ8MTXP02IPIRH.25.35.D02.1.454.CMB.2.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaagtccctgagactctcctgtgcagngtccgcgtccaccttccgtcgttttgcattcactgggtccnccaggctccaggcaaggactggagtcggggngcggtcagtatgggtgggatgggaaagtaatgactagtttttagngacagaccgtaccgtaggaacgggcccactccaaccactccgacgaagacgaccacgactaaccaaagtaccttactttatcgtactactaaagttaacggaaaaccgtgaacgtacgtaccgaaacgaccacggtctacgttacttacgttacgtcggcgggtacgggtactaacggaacggaacggtaacggggtccggggacctacggacggcgtacggtccggaccg

SEQ ID NO: 334411 - DNA, 709 bp, Homo sapiens
  misc_feature: GZ8MTXP02F6U58.25.35.D02.1.454.CMB.2.raw
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcgggggagcgtggtccaggccggggaatccctgacgactctcctgtgcagtcgtccgcgtcccaccttccgtcgtttggctattcacgtggtcccgccaggctccgaggcaagggctgggagtggggtggcggtcagtagtgggtgggatagggaagtaagtggtcttaagtttttagcggtacaagggtacccgttacccgggtaggggaaaccgggggtccccgtaacttcccaacccgtaacgttcccgacccggaagggacgggaccacgggtacccttaaaccccgaaaggttaaaacccttaccctttttaatccgtaacggtaacctaaagtttaaccggaaaaaccgttgaaccgtaactaccgggaacacgaccggtcttacgtaccttaagtttaccgcggtccgggtacggggtactaggaaacggtacggtacgggggtccggggtaccgtacgtacgggactacggtcggggacgtcccgggg

SEQ ID NO: 334412 - DNA, 702 bp, Homo sapiens
  misc_feature: GZ8MTXP02GM6ML.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcgggaggtcggggggaggcgtggtccaggccggggaagtccctgagactctcctgtgcagtgtccgcgtccaccttccgtcgttttggctattcacgtcgggtccgccaggcctccgaggcgaaggggctggaggtggggtggcgtgatagtggtgggagtggaagtaatgtacttagttttctgcgacgtaccgtccgggtaggaaacggggtcccgaccgttacaaccctacgtccctacccgagacggccgaacggacccttaaccaaaacgtaacctttaaccctttttaactccgtacggtaactaaagtttaaaccggaaaacccggttgaaacgtaccgttacggaaaccgaccgtacgggtacttacggttacttaactttacggtcggtaccggggtccgggggttactaacggaacggtaaaccgtaagggggttcccggggtacccgttacggtaccggacgtacgggttacgggaaccccgggg

SEQ ID NO: 334413 - DNA, 602 bp, Homo sapiens
  misc_feature: GZ8MTXP02HL2F0.25.35.D02.1.454.CMB.2.raw
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (566)..(566): a, c, t, g, unknown or other
  misc_feature (566)..(566): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggactcccgggctcagtctgccctgactcagcctcgctcagtgtccgggtctcctggacagtcagtcacatctctgcactggaaccagaatgattcttgggtncttatgacactgtcctcgtggcctacctacgtttacccgaaacgggaaaccncccccaagacgtctacttccttatgtatgtacgagggaacgccggtacccgtacgtaccggggtccctagtacctccgtcttcgtcgttcggtaccaaacgtccgtagactaaaccgccgacccttccacgacccacgtctccgtcggctcgacgctgacggtatcggagctgtaatttattagttgacttggttactagtacgtgacgagtactaacgtattaggtttcggtcggttacgcggacgacggtactacggttccgacgtccgnggtaccgaccgtaccgacggtccgccgttcccccgg

SEQ ID NO: 334414 - DNA, 685 bp, Homo sapiens
  misc_feature: GZ8MTXP02FM4HN.25.35.D02.1.454.CMB.2.raw
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggagggtcggggggagcggtggtccgaggccgggggtaatccctgacgtcctcctccgtggtgcagtcgtccgcgtccctaccgttccgttcgtttgctattcgacgtgggtcccncgaggcctacgaggcgaagggctggaggtgggnggcgtnagtagtgggtgggataggaatacgtgacttaagttttgngacaggtacctcggtaggaacggggccaacctcgaaccctatcctaccgaaggacgacgacgtaccctaaccgaaaacgtaccctttaccgttttacacgtacgtaactaaaagtttaacgggaaaacctcgaaacgtccgtaccggtaaacgacggtacggtacttacgttaaccttacgttcggacggtcccgggtacggggttacgtaagaaacgggtaaccggtcggggtacccgggtaccgttaccggaccggataaccgggtcggaacccggg

SEQ ID NO: 334415 - DNA, 659 bp, Homo sapiens
  misc_feature: GZ8MTXP02JIYJ2.25.35.D02.1.454.CMB.2.raw
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (458)..(458): a, c, t, g, unknown or other
  misc_feature (458)..(458): n is a, c, g, or t
  modified_base (493)..(493): a, c, t, g, unknown or other
  misc_feature (493)..(493): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgcttgggttttcctcgtttgcttcttttaaggaggtgtccagtgtcagatgcaacgtggcggaggtcgggggagcgtggtccaggcgggatccctgagactctcctgtgcagtgtccgctccaccttcgtcgtttgctattcncgtcgggtccncagggctccgagggtaccaaggggtctggggagtggggtcggtccggtanagttaggtggggtggggtaatcggggtaaaatactggacttaagttttgcgacgaggtacctccgggtagacgggtcccactcaaccatccgacgaggacncccagcctaaccaaacgttacctttaaccgtttanacgtacgtaacgtaacgttaaaccggaaaccgtgaaccgacgtaccggaacgtaccggacgtactacgtacgttacgttcggcggtaccggggtacggtactaacgggaacggtaccggtaacggggtccgggaccgtacggtacggcgtacggggtacggaccgg

SEQ ID NO: 334416 - DNA, 547 bp, Homo sapiens
  misc_feature: GZ8MTXP02FO9FP.25.35.D02.1.454.CMB.2.raw
  modified_base (378)..(378): a, c, t, g, unknown or other
  misc_feature (378)..(378): n is a, c, g, or t
  modified_base (446)..(446): a, c, t, g, unknown or other
  misc_feature (446)..(446): n is a, c, g, or t
  modified_base (516)..(516): a, c, t, g, unknown or other
  misc_feature (516)..(516): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccagccggggaagtccctgagactctcctgtgcagtgtccgcgtccaccttccgtcgtttggcattcactgggtcccgccaggctccaggcaaggggactgggagtggggtggcggtcatagtggtgggatggaagtaatgctatttttngcagactccgtgaaacgggcccgactcacccagtctccagaggcagctaccaaagaactaccttttanctgacaattagaaaaccgtgagactcgacgacacggctgtactatacctgcgcgggtctagaacgaacgngggcgggccgtcgtacggcacgtcggaccgg

SEQ ID NO: 334417 - DNA, 603 bp, Homo sapiens
  misc_feature: GZ8MTXP02HZAYM.25.35.D02.1.454.CMB.2.raw
  modified_base (388)..(388): a, c, t, g, unknown or other
  misc_feature (388)..(388): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtgggcggaggtcggggggagcggtggtccgaggccggggaagtccctgagactctcctgtgcagtgtccgcgtccaccttccgtcgtttgctattccacgtggtcccgccgaggcctccgaggaccgaagggctgggaggtggggtggcggtcagtagtgggtggatggaagtatgatatttangctagtacgtccgtggacgggcctacgtcaccntcncgagagcacgctacaacgtactccgtttanctanacttaaagtacgtaaaacgtgaacgaccgtacgaccgacgtacggtctacgttacttacgtacgtcggcgggtacgggtacctaggaaacgtaccgacggggtccgggacgtaccgtacgggactacggtcgggaccgcccgggg

SEQ ID NO: 334418 - DNA, 594 bp, Homo sapiens
  misc_feature: GZ8MTXP02FPADZ.25.35.D02.1.454.CMB.2.raw
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (379)..(379): a, c, t, g, unknown or other
  misc_feature (379)..(379): n is a, c, g, or t
  modified_base (412)..(412): a, c, t, g, unknown or other
  misc_feature (412)..(412): n is a, c, g, or t
  modified_base (453)..(453): a, c, t, g, unknown or other
  misc_feature (453)..(453): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggagtcgggggaggcgtggtccaggccggggaatccctgagactctcctgtgcagtcgtccgcgtccaccttccgtcgtttgctattcacgtgggtcccncaggctccgaggcgaagggctggaggtggggtggcgtnagtagtggtgggatggaagtatgacttattttncgcagacctcggtagaacgggccctatccaccntcaccgagacgcaacgcctacgaaacgtaccttacttttanacgtcgaactaaagttacggaaaaccgttgaacgtaaccgtacgaacgacgtacggcttagtactagttacgcggcggtcgggtacgtagaaacggaacgtcgggggtccgggaccgtacggcggacacgtcggaacccgg

SEQ ID NO: 334419 - DNA, 663 bp, Homo sapiens
  misc_feature: GZ8MTXP02F0A7W.25.35.D02.1.454.CMB.2.raw
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (469)..(469): a, c, t, g, unknown or other
  misc_feature (469)..(469): n is a, c, g, or t
  modified_base (510)..(510): a, c, t, g, unknown or other
  misc_feature (510)..(510): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttctttttaaggaggttgtccagtgtcagatgcaacgtggcgggaggtcggggggagcgtggtccaggccggggaatccctgagctctctgtgcagtcgtccgcgtcctaccgtttccgtcgtttaggctattccgacgtcgggtccnccaggtcctcgagggccaaaggggcgttgggaggttggggnggtcccggtanaggttagtcgggggtagggtaattggggaaaagttatcgtattagtttttagcgacagtaccgtccggtaggaacgggtcccagtccacgtactccncgaagcggctagaccctacgaaacgtacttaccttttaacncgtactaactaaacgttaacggaaacgtgaacgtacgaccggaacgacgtacgtacgttacgttactaacgtcggtacgggcggtacgggtactaacggaacggacgggtccgggggtccggaccgtacgacggtacgtacggaccggaccgg

SEQ ID NO: 334420 - DNA, 587 bp, Homo sapiens
  misc_feature: GZ8MTXP02FKZPE.25.35.D02.1.454.CMB.2.raw
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaagtccctgagactctcctgtgcagtcgtccgcgtcccaccttccgtcgtttggcattcactggtccncaggctccaggcaaggctggagtgggnggcggtnagtatgggtggatggaataatgctatttangcagtactccgagaaggccactcacatcacagngcagctaccaagaaacctctttacnctagactaagtaacgaaacgtgaacgtacacggaacgacgacggtctacgttactaacgttacgtcggaccgggtacggggttactaacgggaaacggtacggtacgggggtccgggtacccgtacggtaccggacgtacggtacgggacccggtaccgg

SEQ ID NO: 334421 - DNA, 578 bp, Homo sapiens
  misc_feature: GZ8MTXP02GN4SV.25.35.D02.1.454.CMB.2.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (512)..(512): a, c, t, g, unknown or other
  misc_feature (512)..(512): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaatccctgagactctcctgtgcagtcgtccgcgtccaccttccgtcgtttggctattcactgggtccncaggctccaggcgaaggctgggagtgggnggcggtcagtagtggtgggatgggaataagtgacttaattttangcagaccgttccgtaggaaacgggccactcaccgtatcctccgagacggcacggactacccgaaagaaccttaccgttttaacnctatactaagtacgaaacgtnaacgcacgacgacgagctgtactactcgngacggtcggtacacgaacgaacgtacggggtccggcgtacggtacgacgtacgtccggacgtccgg

SEQ ID NO: 334422 - DNA, 516 bp, Homo sapiens
  misc_feature: GZ8MTXP02GE3HI.25.35.D02.1.454.CMB.2.raw
  modified_base (305)..(305): a, c, t, g, unknown or other
  misc_feature (305)..(305): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgtttggctattcactgggtccnccaggcctccaggcaagggactggagtgggtggcgtcatagtggtggatggaaagtatgctatttngcagactccgtagaacgggccactcaccatcncagagcagctacaagactctttanctnatatacgaactgacncacgacgacacgctntactagtcncgcgtcggtacagaacgacgcgggtcggctacgacgcgagtcggacg

SEQ ID NO: 334423 - DNA, 633 bp, Homo sapiens
  misc_feature: GZ8MTXP02FXJKP.25.35.D02.1.454.CMB.2.raw
  modified_base (480)..(480): a, c, t, g, unknown or other
  misc_feature (480)..(480): n is a, c, g, or t
  modified_base (493)..(493): a, c, t, g, unknown or other
  misc_feature (493)..(493): n is a, c, g, or t
  modified_base (526)..(526): a, c, t, g, unknown or other
  misc_feature (526)..(526): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcgggggagcggtggtccgaggccggggaagtcccgtgacgactctcctgtgcagtcgtccgcgtcctaccttccgtcgtttcggctattcacgtcggtccgccaggcctccgaggccgaagggctgggaggtgggtcggcggtcagtaggtggggtagggatacgggaaagttaacgtggtacttatttttagcgtacagtaaccgtccggtaggaaacggggcccaactccaaccactcctaccgagacgcacgactaccgaaanaccttacctttanctacgactaagttacgaaaaccgtgacgtaccncggacgacgacgtctacgttactacgtcgtcggacggtacggggttacaaggaacggtaaccggaaggggtccgggtccgtacggtcgacgtacggtacggacccgg

SEQ ID NO: 334424 - DNA, 612 bp, Homo sapiens
  misc_feature: GZ8MTXP02H8JPD.25.35.D02.1.454.CMB.2.raw
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
  modified_base (453)..(453): a, c, t, g, unknown or other
  misc_feature (453)..(453): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaatccctgagactctcctgtgcagtcgtccgcgtcccaccttccggtcgttttggctattcactgggtccnccaggcctccgaggcaagggactggagtggggtggcgtcagtagtgggtgggatggaagtaatgcttattttgngcagacctcgtaggacgggcccactcaccgatccgtaccgagaggcagcctaccgaagaactactttancctgactaattagaaaaccgtgacgtacctcggaacgaccacgggtcttcggtacttacgttacgtcggaccgggtcgggggttacaaggaaacggaaacggtaacgggggtcccggggtaccgttacggaaccgggcgacggttcggggaaccccggg

SEQ ID NO: 334425 - DNA, 739 bp, Homo sapiens
  misc_feature: GZ8MTXP02JRSR0.25.35.D02.1.454.CMB.2.raw
  modified_base (328)..(328): a, c, t, g, unknown or other
  misc_feature (328)..(328): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcgttgggttttcctcgttgcttcttttaagaggtgtccagtgtcagatgcaacgtggcgggaggtcgggggaggcggtgggtccgagggccggggaagtccccgtggagacctctccgtgtgcagtcgccgcgtcccaccgttccgtcgttttggcctattcacgtcgggtcccnccacggcctccgaggacgaaggcgtggaggtggggtcggcggtacagtagtggggtagggagttagggaaagttaaagtggacctttaagtttttagtcggactaaacggtaccgtccgggttacgggaaaacggggcccgtacccgttaccaccctacgtccgtacccgaagggacgcgaacgtacctaaccgaacgtaaaccgttaccttttactcgtacgaacttaagtaacggaaaccgttagaaccgtaccgtacggaaccgaccggtacgtacgtaccttacgttaaccgtttacggccgggtaccggggtacgggttcgtaacgggaaacggtaaccggggtaacggggtacccgggggtacccgttacggaaccggcgttaaccgggacgggtaaccccgggg

SEQ ID NO: 334426 - DNA, 576 bp, Homo sapiens
  misc_feature: GZ8MTXP02JWR8D.25.35.D02.1.454.CMB.2.raw
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (456)..(456): a, c, t, g, unknown or other
  misc_feature (456)..(456): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatcccgtgacgactctcctgtgcagtgtccgcgtccaccttccgtcgttttggctattcactgggtccnccaggcctccaggcaagggactgggagtggggtggcggtcagtagtgggtgggatggaagtaatgctattttcgngcagtacgtcgtagacgggccacnccaccnctccncgagacgcacgacctaccgaaacgtaaccttactttanctagtactaagttacgaaacgtgaacgactacgacgacgacgtctacgtactagtacgtcggcggtacgggtcacggaacggacggtcgggtccggaccgtacgacggcgtacggcggcg

SEQ ID NO: 334427 - DNA, 682 bp, Homo sapiens
  misc_feature: GZ8MTXP02H8ZJV.25.35.D02.1.454.CMB.2.raw
  modified_base (313)..(313): a, c, t, g, unknown or other
  misc_feature (313)..(313): n is a, c, g, or t
tcagactgtacagtcacgaccggtgctcgatttagcacacgatagttgggtttggggagctctgggagaggagcccagcactagaagtcggcgtgttccatccggtgatcagcactgaacacagaggactcagcatggagtttgggctgcgctgggttttcctcgttgctcttttaagaggtgtccagtgtcagatgcaactggcgggaggtcggggggaggcgtggtcaggccggggaagtccctgagactctcctgtgcagtgtccgcgtcccaccttccggttcgtttggctattcactcggggtccccnccgaggctccgaggacgaagggtacgtgggagggtggggtggcgtatagtaggtggggtagggagtagggtaaagtagtgtacttaagttttgcgacgtacggtaccgttaccgggtaagggaaacgggccctacctaccacctactccgtacgaggacgcacgtaccctaaccgtaaagtaaacctttaccgttttataccgtacgtaactaaacgttaacggaaaccgtgaaacgtaccgtacgaacgtacgacgtcttacgttacttacgttacgtcgggtccggggtacgggttacaacgggtaacggaacgggtaacgggggtcccgggtacgtaccggtacggacgtacggtaccggggccgg

SEQ ID NO: 334428 - DNA, 573 bp, Homo sapiens
  misc_feature: GZ8MTXP02HXTS2.25.35.D02.1.454.CMB.2.raw
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtcccgtgagactctcctgtgcagtgtccgcgtccaccttccgtcgttttggctattcactgggtccncaggctccaggcaagggctggagtggggtgcggtnagtgtggtggatggaataatgctattttngcagacctcgtagaaggcccgactcaccgatcctcgagtacggctagcctaccgaaagacctacctttttacnctanactaagtacgaaacgtgacgacgcgacgacgacgtcttcgtactagttacgcggtccggtacggtacgacggaacgacggtaacggggtccgggtccgtacggacggacgacggtaccgggaccg

SEQ ID NO: 334429 - DNA, 673 bp, Homo sapiens
  misc_feature: GZ8MTXP02IA2FN.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcgggaggtcggggggaggcggtgggtccgaggccggggaagtcccgtgagactctcctgtgcagtcgtccgcgtcccaccttccgtcgtttgctattcacgtcgggtccgccaggcctccgaggacgaagggcgtgggaggtggggtggcgtcagtagtgggtcgggagtagggtaagtaagtgtacttagtttttagcgactacggtaccgtaccgggtaggggaacgggacccaccctacgaaccctacgtcccgtacccgaagacggcaacgtaccctaaccgaaagtaaaccttacctttttacacctagtaactaaagttacgaaaaaccgttgaaacgtacctacggacgaacgacggtacttacgttacctagttcgacgtcgggacgggtactaagggaacggtaacggtcggggttccggggaccctcggtaacggcgtaacggccggaaccggg

SEQ ID NO: 334430 - DNA, 604 bp, Homo sapiens
  misc_feature: GZ8MTXP02HCP1U.25.35.D02.1.454.CMB.2.raw
  modified_base (337)..(337): a, c, t, g, unknown or other
  misc_feature (337)..(337): n is a, c, g, or t
  modified_base (460)..(460): a, c, t, g, unknown or other
  misc_feature (460)..(460): n is a, c, g, or t
  modified_base (524)..(524): a, c, t, g, unknown or other
  misc_feature (524)..(524): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgttttggcattcactgggtcccgccagggcctccaggcaagggctggagtgggnggcggtcagtagtggtgggatggaaagtaatggactattttagtgctagacctccggtaggaacggggcccgactccaaccgatcctaccgagaggccagtctaccaaagaactaccttttanctagtaccaattacgaaaaccgtgaacgactacgaacgtacgacggtctggtaccttagttacncggtcggacggggttacctaggaaacggaaccgaaggggttcccggggaccgttcgaacgggccgacggtacggacccgg

SEQ ID NO: 334431 - DNA, 648 bp, Homo sapiens
  misc_feature: GZ8MTXP02HC4LC.25.35.D02.1.454.CMB.2.raw
  modified_base (409)..(409): a, c, t, g, unknown or other
  misc_feature (409)..(409): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcgggggagcgtggtccgaggccgggaagtccctgagactctcctgtgcagtcgtccgcgtcctaccgttccgtcgttttggctacttccgacgtcgggtcccgccgaggcctaccgaggccgaaggggacgtgggaggtggggtaggcggtcagtaggtgggtgggagtaggaagtaatggtacttattttagngactaggactccggtaggaacgggcccacgtacacctatcgtaccaagcgaccaggacctaaccgaaacgtaaccttacctttactccgtagtactaaagttacggaaaaccgtgaacgtaaccgtacgaaccgacgacggtctacggttactacgttacgcgggtaccgggtcggtaccgtaggaacggaaacggtcgggggttccgggacctacggaacggctaacggcggacccgg

SEQ ID NO: 334432 - DNA, 591 bp, Homo sapiens
  misc_feature: GZ8MTXP02F63R8.25.35.D02.1.454.CMB.2.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (455)..(455): a, c, t, g, unknown or other
  misc_feature (455)..(455): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggagtcggggggagcgtggtccgaggccggggaagtccctgagactctcctgtgcagtgtccgcgtccaccttccgtcgtttgctattcacgtggtcccncaggcctccgaggcaagggctggagtgggtggcgtnagtagtggngggatggaagtatgacttatttngacagacctccggtaggaacgggcctactcacatcctcgaagcggaccagacctaccgaaagtaaccttaccgttttanctacgactaagttaacgaaacgtcgacgacgtacgacgacgacgtctacgtacttacgttacgtcggcggtacgggtacaacggaacgaacggtcgggggtcccggaccgtacggacggacgtacggtcggaccgg

SEQ ID NO: 334433 - DNA, 739 bp, Homo sapiens
  misc_feature: GZ8MTXP02I7S9Z.25.35.D02.1.454.CMB.2.raw
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcgggggagcgtggtcaggcgggatcccngacgactctctgtgcagtcgtccgctccnccttcgtcgtttgctatcacgtggtccncaggctccgaggcaagggactggaggtggggnggtcgtacgataggtcggnggggatacgggaaagttaagtggtactttaagtttttcgacgtacgtaacggtacccgttccggtaaggggaaaccggggccccgtaaactttcccaaaccctagttaccccgtacggaacggaacggtccgaacggtacccttaacccgaaaaacggttaacctttaaacccgtttttaaagtccgtaacgttaaccgtaaagtttaaaccgggaaaaccgttggaaaccggttacgacccggaaaccggaccgtaccggtccgtaacgttaccgtaacgtttaccggacgggtaccggtacggggttacaaaacgggtaacggtaaacgggtaaccggggtacccgggtacgttacggaaccgggtcgtaacgggtacggacccgg

SEQ ID NO: 334434 - DNA, 666 bp, Homo sapiens
  misc_feature: GZ8MTXP02G70DB.25.35.D02.1.454.CMB.2.raw
  modified_base (400)..(400): a, c, t, g, unknown or other
  misc_feature (400)..(400): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccgaggccggggaatcccgtgacgtactctcctgtgcagtcgtccgcgtccctaccgttccgtcgttttgctacttccgacgtcggtcccgccaggcctccgaggcaagggctgggaggtgggtggcggtcagtagtgggtggataggaaagtagtgtacttagttttgngacgagtaccgtccggtaggaaacgggcccgtaactccgaaccctactccgtaccgaaggacggaccacggtcctaacccgaaaagttaacccttaacctttttacacttacggtaaccttaaagttaccggaaaaccgtgaacgtaccgtacggaaccgacgtacggtcttacggttacttacgttacgcggtacggtcggggtactaggaaacgtacggaacggggtccggtaccgtacgtaccggcgtacggtacgggaccgg

SEQ ID NO: 334435 - DNA, 677 bp, Homo sapiens
  misc_feature: GZ8MTXP02JFVL7.25.35.D02.1.454.CMB.2.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccaggccgggatccctgagctctcctgtgcagtcgtccgcgtcctaccgttccgtcgtttggctattccacgtcggtccnccaggcctccgaggcaaggggcgtgggaggtggggnggcggtctagtagtgggtaggagtaggaaacttaagtgacgttaatttttagngtacgaagtaccgtccggtagggaaaccgggccctaacctccgacccacttaccgaccgaggacgaccgacgaccctaaccgaaacgtaaccctttacctttacgtacctacgtacctaaacgttaacgaaaaccgttggaacgtaacccgtacgaaaccgacgtaccggcttacgttaccttaagtcgtcggacgggtacgggtacgtacggaacggaacggtcgggggtacccggggtccgttacggaacggaccgttacggaccggtacccgggg

SEQ ID NO: 334436 - DNA, 635 bp, Homo sapiens
  misc_feature: GZ8MTXP02JXADA.25.35.D02.1.454.CMB.2.raw
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
  modified_base (486)..(486): a, c, t, g, unknown or other
  misc_feature (486)..(486): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccgaggccggggaagtcccgtgagactctcctgtgcagtgtccgcgtcccaccgttccgtcgttttgctattcacgtcgggtccncaggcctccgaggcaagggactgggagtggggtggcggtcagtagtgggtaggatgggaataagtgacttattttagcgacacggtaccgtccggtaggaaacggggcccacgtccaaaccngtacctaccgaggacggctaggacctaccgaaacgtaaccttaccgttttanacctagactaagttacggaaaaccgttgaaacgtacgtacgacgacgacggtctaggtactacgttacgcggacggtacgggtactaggaaacggtacgaacggggtcccggggtaccttacggacggcgttaacggcggggaacccgg

SEQ ID NO: 334437 - DNA, 688 bp, Homo sapiens
  misc_feature: GZ8MTXP02H6RKW.25.35.D02.1.454.CMB.2.raw
  modified_base (199)..(199): a, c, t, g, unknown or other
  misc_feature (199)..(199): n is a, c, g, or t
  modified_base (314)..(314): a, c, t, g, unknown or other
  misc_feature (314)..(314): n is a, c, g, or t
  modified_base (411)..(411): a, c, t, g, unknown or other
  misc_feature (411)..(411): n is a, c, g, or t
tcagactgtacagtcacgaccggtgctcgatttagcacacgatagttgggtttgggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatncaactggcggaggtcgggggaggcgtggtccaggccggggaatcccgtgagctctccgtgtgcaggtcgtccgcgtcccaccgttccgtcgttttggctattcacgtcgggtccnccagggtcctccgaggacgaaaggggtcctgggacggtggggtggcggtacagtagtgggtgggagtagggaaacgtaatggacttaagtttttagngtacaagtaccgtccggtagggaaacggtcccgaaccttcgaccgtatcctaccgaagacgccacgtacctaacccgaaagtaaaccttacctttttaatccttaacggtaccttaaaagttacggaaaaaacccggttgaaacggaaccgttacccggaacgaaccgacgggtcctacggttactaacgtttacgtcggaccggtcgggtactacggaacggaacggtaacggggtcggggaacccttcggacgggctaacggttcggaacccggg

SEQ ID NO: 334438 - DNA, 851 bp, Homo sapiens
  misc_feature: GZ8MTXP02IZ0RX.25.35.D02.1.454.CMB.2.raw
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggtggaggtcggggggagcggtggtccgaggccggggaactccctgacgacctctctgtgcagtcgtccgcgtcctaccgttcgtcgtttggctattcacgtcggtcccncaggtcctccgaggaccgaaggggtctgggagggtggggtggtccggtacagttagggtgggtaggggtaatagggaaattaagtgtactttaagttttgngaccgtaggtacccgttccggggtaagggaaaccgggggtccctaaacgtcccgtaaacccgtacgttaccccggtaacccggaagggaacgggcccctaaacgggtaccccctttaaaccggaaaaacccgggtaaacccgtttttaaaccccttttttaaacgtacccggttaaacgggttaaaccctttaaaacgggttttaaaaccggggaaaaaccccccggttaggaaaccggttaaccccgttaccggggaaaacccggtaccggtaaccggggtcctttaacggtttacccttaacgttttaaccggcggggtaacccgggggttccggggttacgtaaacgggaaaaccggtaaccgggtccgggggttacccggggtccgtttaacccggaccgggacgttaacggttacggggaacccccgggg

SEQ ID NO: 334439 - DNA, 627 bp, Homo sapiens
  misc_feature: GZ8MTXP02IQB23.25.35.D02.1.454.CMB.2.raw
  modified_base (319)..(319): a, c, t, g, unknown or other
  misc_feature (319)..(319): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtctgggttttcctcgttgcttcttttaagaggtgtccagtgtcagatgcaactggcggaggtcgggggagcggtggtccaggccggggaagtcccgtgacgactctcctgtcgcagtcgtccgcgtcctaccttccgttcgtttgctattccgacgtcgggtcccnccgagggccctaccgaggaccgaaaggggactgggaggtggggtggccggtcagtaggtgggtagggagtaggtaaagttagtgacttattttagcgactagtaccgttccggaggaaacggtcccgactaccacctactctccgagacgacacgactacaacgtaactactttatctagtactaaattacgaaaaccgtgaacgtacgacgaacgaccgacggtctaacgtctacgttacgcgacggtacgggtacacggtaacgacggaacgggtccgggccgtacgacggctacggtcgaccggg

SEQ ID NO: 334440 - DNA, 601 bp, Homo sapiens
  misc_feature: GZ8MTXP02IMRIW.25.35.D02.1.454.CMB.2.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgctgggttttcctcgttgctcttttaagaggtgtccagtgtcagatgcaactggcggaggtcgggggaggcgtggtccaggccggggaagtccctgagctctcctgtgcagtgtccgcgtcccaccttccgtgtttgctattcacgtggtccnccaggcctcaggcagtggactgggagtggggtgcgtnatgtggtggatggaatatgctnttttnggcagacgtcgtaggaacgggccactccacatctccgaagcggacncgaccgtacccaaagtaaacccttaacctttttanaccttagtacctaagtttaacgaaaacccgttgaacgtaacgtacggacgtaccgacggtctacgtaccttataccgtggaccggtcgggtactagaaacggtaacggcgggggtaccgggtccgttacggtaacccggcgtacggtcgg

SEQ ID NO: 334441 - DNA, 626 bp, Homo sapiens
  misc_feature: GZ8MTXP02GOLDJ.25.35.D02.1.454.CMB.2.raw
tcagactgtacagtcacgaccggtgctcgatttagcacacgatagttgggtttgggggggtctcaggaggcagcactctcgggacgtctccaccatggcctgggctctgctcctcctcagccctcctcactcagggcacaggatcccgggctcagtctgccctgactcagcctcgctcagtgtccggtctccgtggacagtcagtcaccatctctgcactggaaccagaagtgtatcgttggtgtcttatgactactgtctctggccacctagtttaccaggaaacgaccccgagacgtcactcctttatcgagtgtcgagggaacggccggaccctcgacgggtcccgtcgtacgtcgtcttactcgtacggtacctaatcgtacgacctacgaccgtcccgtcctcgaaccctctccgtcgtcgggtcctacgaacgggtcgtcggaacgtaagtggagtaccgtagttattatttagttgtcttggttacctatagttagccggtagtacctaacgtacgttagttttggtacggtttcgacggtcgaacgggttaccgtaaacgttcggtaccctcggttacggtaccgacggtacccgtaaggcccgtaccggttcccccg

SEQ ID NO: 334442 - DNA, 584 bp, Homo sapiens
  misc_feature: GZ8MTXP02F28H4.25.35.D02.1.454.CMB.2.raw
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcgagtcgggggagcgtggtccagccgggaagtccctgagactctcctgtgcagtgtccgcgtccacttcgtcgtttggcattcactggtccncaggctccagcaaggactgagggtcgtggcggtcatatggtgggaatggaaagtaatcgactattttagcnacgactacgtagaggacgactacacactactacagagacacgacacaaacaaactaactttaacttactacgtactaactaacgtaaaacgtaacgagacgtacgaacgaacgaacgacgtacgtactacttacgtacgtacggtacgggtacgtacgaacgaaacggtaacgggtaccgggtaccggtaccgtacgtacgtacgtacggtacgg

SEQ ID NO: 334443 - DNA, 782 bp, Homo sapiens
  misc_feature: GZ8MTXP02JOVL2.25.35.D02.1.454.CMB.2.raw
  modified_base (393)..(393): a, c, t, g, unknown or other
  misc_feature (393)..(393): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggagtcgggggagcgtggtccgaggccggggaagtccctgacgactctcctgtgcagtgtcccgcgtccaccttccgtcgttttggctattcgactcgggtccgccaggcctccgaggcaaggggctggaggtggggtggcggtcagtagtgggtaggatgggaagtaagtgacttatttttagngacgtaagtaccgtcggtaggaaacggggcccgtaacgtccaacccgattccgtacccgaagggtacgccgaacggtaccctaacccgaaaaggtaaacccctttaccctttttaaacgtccgttacgggtaaaccttaaaacgttttaacggggaaaaaacccccgttgggtaaaaccggtaccccgttaccgggaaaccggaacccgtaacccggggttcttaacgggtttacccttaaagttttacccggcggggtacccggggttacccgggggtttaaccgacggggaaaaaccggtaaaccggggtaacgggggttcccccgggggtacccgtttacccgggtaaccggggccgttaacgggttccgggggaaacccccgggg

SEQ ID NO: 334444 - DNA, 696 bp, Homo sapiens
  misc_feature: GZ8MTXP02JE0VF.25.35.D02.1.454.CMB.2.raw
  modified_base (351)..(351): a, c, t, g, unknown or other
  misc_feature (351)..(351): n is a, c, g, or t
  modified_base (400)..(400): a, c, t, g, unknown or other
  misc_feature (400)..(400): n is a, c, g, or t
  modified_base (517)..(517): a, c, t, g, unknown or other
  misc_feature (517)..(517): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtgggtccaggccggggaagtccctgacgactcgtcctgtgcagtgtccgcgtccaccttccgtcgtttggctattcacgtggtccgccaggcctccgaggcaaggggctgggagtggggtggccgtnagtagtgggtggggattaggggaaattaacgtggacttaagtttttagngacgtaggtaaccgttcccgggtaagggaacgggggaccccctaacttcccgaaaccctatcccgtacccgaggacggccaaacgtccctaccgaaacgtaacctaccctttttaanctcggaacttaagttaaccggtaaaacccgtgaaacgccgttaacggaccgtacaccgggtctaggttacccttaagttaccgtcgggccgtacccgggggttataacggggaaagtaaccgggtaacgggggtcccgggggtcccttacgtaaccgggccaggttacggggaaccccg

SEQ ID NO: 334445 - DNA, 712 bp, Homo sapiens
  misc_feature: GZ8MTXP02HLLMJ.25.35.D02.1.454.CMB.2.raw
  modified_base (247)..(247): a, c, t, g, unknown or other
  misc_feature (247)..(247): n is a, c, g, or t
  modified_base (549)..(549): a, c, t, g, unknown or other
  misc_feature (549)..(549): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggaggcgtggtccaggccgggagtcccngagactctcctgtgcagtcgtccgcgtcctaccgttccggtcgttttcggctattccacgtcggtccgccaggtcctaccgaggacaaaggggtcgtgggtacgggtggggtcggcggtacagttacggtggggtagggtagtaggggtaaagttaatggtacttaagttttagtcgacgaacggtaccgttacccgggtaggaaaccggggtccctaaagtcccaacctaagtcccgtacccgaaggaaccggcaacggttcccaaaccggtaaaactacccttaaaccccgttttttaanaccgttacgtaacgtaaacgttaaacggaaaccgtgaacgtaccgtaacgacgtaccgtacggtctacgttacttaacgttcggacggacggttcgggtagtaaacggaacggtaacgggcgggtccgggtaccgtacggacgtacgtacggtaccgggacgg

SEQ ID NO: 334446 - DNA, 683 bp, Homo sapiens
  misc_feature: GZ8MTXP02GODJT.25.35.D02.1.454.CMB.2.raw
  modified_base (389)..(389): a, c, t, g, unknown or other
  misc_feature (389)..(389): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcgggggagcgtggtccagccggggaatccctgagactctcctgtgcagtgtccgcgtcccaccttccggtgttttggctattcacgtgggtccgccagggcctccgaggcaaggggactggacgtgggtggcggtcagtagtgggtggatggaagtaactggctaagtttttagngactacgtacgtccggtaggaacgggccctaactaccaacctacttaccgaccgaacggacggacctaacgaccctaaaccgaaacgtaaacctttaacctttacaccgtacgtaaacgtaaacgttaaacggaaaaccgtagaaccgtaccgtaccggaaaccgaacgtaccggtacttacgttactacgttacgcgggtaccgggtacgggtacgtaacggaaacggtaacggtaaccgggggtacccggggtaccgttaccgacgggtaccgtaacgggttaccggaccgg

SEQ ID NO: 334447 - DNA, 597 bp, Homo sapiens
  misc_feature: GZ8MTXP02JIUH1.25.35.D02.1.454.CMB.2.raw
  modified_base (181)..(181): a, c, t, g, unknown or other
  misc_feature (181)..(181): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
  modified_base (438)..(438): a, c, t, g, unknown or other
  misc_feature (438)..(438): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagnggtgtccagtgtcagatgcaactggcggagtcggggggagcgtggtccaggccgggggaatcctgagactctcctgtgcagtgtccgacgtccaccttccgcgtttgcattcactggtccncaggctccaggcaaagggtctggagtggggtgccggtanagtagtggtagggaactaggaaatacgngtattaatttgcgacagacgtccgaggaacgggccaactcaactatcgtacagacgcagtcaacgaaanaacttactttagactagaataagttaacggaaaacctgaacgacgtacgaacgacgacgacgtacgtacgtactacgtacgtacggtacgggtacgtacgaaacgaaacggtaacgggtaccgggtacccggtacgtacggtacgtacgtacggtacgg

SEQ ID NO: 334448 - DNA, 666 bp, Homo sapiens
  misc_feature: GZ8MTXP02I8YVP.25.35.D02.1.454.CMB.2.raw
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatccctgagactctcctgtgcagtcgtccgcgtccaccttccgtcgttttggctattcacgtgggtcccnccaggcctccgaggcaagggctgggagtgggtggcggtcatagtggtggatggaatatgactattttngacagaccgtccgtggaaacgggtcccatcgacccagtccnccgaagnggacacgcctaccgaaagtacctacctttatctacgtactaacgtttacggaaaacccgttgacgtaaccgtaccgggaacgtaaccgtacgggtacccttaggtaccctttaaggtttaaccggcgggtaccgggtcgggggtttacctaacgggaaaacggtaaaccggtcgggggtttacccgggggacccgtttaaccggtaccggggacccgtaaggttcccgggggtaaccccggg

SEQ ID NO: 334449 - DNA, 575 bp, Homo sapiens
  misc_feature: GZ8MTXP02GPG2K.25.35.D02.1.454.CMB.2.raw
  modified_base (151)..(151): a, c, t, g, unknown or other
  misc_feature (151)..(151): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
tcagactgtacagtcacgaccggtgctcgatttagcacacgatagttgggtttgggggggtctcaggaggcagcactctcgggacgtctccaccatggcctgggctctgctcctcctcagccctcctcactcagggcacaggatcccgggntcagtctgccctgactcagcctcgctcagtgtccgggtctcctggacagtcagtcaccatctcctgcactggaaccagaagtgattcgttggtgtcttatgactactgtctcctggccacctagtttacccaaggaaacgcccccagagtcatccttatgatgtcaggacgcggcctcgacgggtcctgactcgtcttctcgtcggtaccaaatcgtgacaacgaccggcctccncgaccatctcngggcctcgagctggacgngtgagtctagtattattacgttgtacttcgttactaattagttagacgtaaggactaaacgttacttaagttttcggtacggtttcggaccggtacgtacgggtacgtaagttcgtaaccgtcgtacggtacacgaccgtaacggtcctaccgtcccccg

SEQ ID NO: 334450 - DNA, 738 bp, Homo sapiens
  misc_feature: GZ8MTXP02JTKHI.25.35.D02.1.454.CMB.2.raw
  modified_base (249)..(249): a, c, t, g, unknown or other
  misc_feature (249)..(249): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccgaggccggggaagtcccgngacgactctccgtgtcgcagtcgtccgcgtccaccgttccgtcgttttggcctattcacgtcgggtcccgccaggcctaccgaggccgaagggcgtggaggtggggtggcggtacngtagtggtagggagtggtaaagtatcgtatttattcgngacgtaccgtccgtacggacggaccgggacctacgtaccctacgtactcccgtacgacgtacgacgaccgtaccgtaaaccggtaaaccttacctttttaaacctttctacgtaaccggtaacgtttaaacgtaaaacccgggttaaaggtaccgtaacgtacccgaacggtaccaccggtacgtcttacgttacgttaaaccgttccgggtcggtaccccgggggttagtacgggaaacgggtaaccggtaaacgggggttcccgggggtacccggggttacccgtacccgggtaacgggtaccggtacgggggtaccccggtaaccccggggg

SEQ ID NO: 334451 - DNA, 610 bp, Homo sapiens
  misc_feature: GZ8MTXP02I34DJ.25.35.D02.1.454.CMB.2.raw
  modified_base (184)..(184): a, c, t, g, unknown or other
  misc_feature (184)..(184): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (447)..(447): a, c, t, g, unknown or other
  misc_feature (447)..(447): n is a, c, g, or t
  modified_base (470)..(470): a, c, t, g, unknown or other
  misc_feature (470)..(470): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaactgggcgggaggtcggggggagcggtggtccgaggccgggggaagtccctggacgactctccgtgtcgcaggtcgtcccgctcctaccttccgtcgttttggctattcacgtgggtccnccgaggctaccgaggacaagggctgggagtgggtggcgtnatagtggcggatggaatatgntatttagngacagtacctcgtaaggaacgggtccctactcgaacctatcgtacagacgcacncctaacaaagtacttacctttancgtacgtaactaagtacgaaaaccgtgaacgtacgtacgaccgtacgacgtactagttaactgttaaccggcggtaccggtcggtactaacggaacggacggtcggggtccggacctacggacgacgtagtaccggacgg

SEQ ID NO: 334452 - DNA, 572 bp, Homo sapiens
  misc_feature: GZ8MTXP02HKW7T.25.35.D02.1.454.CMB.2.raw
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactgggcggaggtcggggggaggcgtggtccaggccggggaagtccctgagactctctgtgcagtgtccgcgtccaccttccgtcgttttgctattcagtggtccncagctcaggcaagggctggagtgggtggcgtacatagtggtggatggaaagtatgacttatttngacagtactccgtagaaggggccaacncacatcacagagcagcacaaactaacttactttatctanataaagttaacgaaaacgtgaacgactacgaacgacacggtctagtactaacttacgtcgcggtacgggtacgtacgaaacggaaacgaacggggtacggggtaccggtacgtacggacgtacggtacggacgg

SEQ ID NO: 334453 - DNA, 750 bp, Homo sapiens
  misc_feature: GZ8MTXP02FX2IN.25.35.D02.1.454.CMB.2.raw
  modified_base (184)..(184): a, c, t, g, unknown or other
  misc_feature (184)..(184): n is a, c, g, or t
  modified_base (277)..(277): a, c, t, g, unknown or other
  misc_feature (277)..(277): n is a, c, g, or t
  modified_base (324)..(324): a, c, t, g, unknown or other
  misc_feature (324)..(324): n is a, c, g, or t
  modified_base (380)..(380): a, c, t, g, unknown or other
  misc_feature (380)..(380): n is a, c, g, or t
tcagactgtacagtcacgaccggtgctcgatttagcacacgatagttgggtttgggggagctctgggagaggagcccagcactagaagtcggcggtgtttccatccggtgatcagcactgaacacagaggactcagcatggagtttgggctgcgcttgggttttcctcgttgcttcttttaagnggtgtccagtgtcagatgcaacgtgggcgggaggtcggggggaggtcgtggtccgagggccgggggaatcccgtgacgacctctccgtgtgcngtcgtccgctccaccttccggtcgtttggctatcgacgtgggtcccnccgacggtcctccgagggaccgaaaggggcgtagggagggtcggggtgggccggtnagttaggtggggtcggggtagtagggaaagttaatggacttaagttttgcgtaccgaggtacccgtcggttaacgggaaacggggccctacgtaccaaccgtactaccgtaccaagggaacgcgtaacgccttaacccgaaaacgtaaccttacccttttaacgtaccttaggtaaccttaagttaaaccgaaaacggtacgaacggtaaccgtaccggaaaccgaaccgtacgggtaccttacggtacctttaaacgttaccggtcggtaaccgggggtcggggtacctaaggtaacggaccgggtaaacgggggtcccgggggtaaccttaccgggaccgggtaacacgggttccgggaaccccgggg

SEQ ID NO: 334454 - DNA, 611 bp, Homo sapiens
  misc_feature: GZ8MTXP02H4VNH.25.35.D02.1.454.CMB.2.raw
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccgggaagtccctgagactctcctgtgcagtgtccgcgtccaccttccgtcgttttggctattcacgtcggtccccgccaggcctcccgaggcaagggactggggagtcgggtaggccggtnatagtggtggatggaagtaatcgntattttagngnagctcgaggacgcactcacnctcacgagacgacacgactacaactacttacctttatctacgtacttaacgttaacgaaacgtacgaacgtacgtacgacgaccgtttacgacttacgttacttacgttacgtcggtaccgggtcgggtacgtacggaacggtaaccggtaccggggtaaccgggtaccgtaccggtacggaccgtacggtacggaccggtccgg

SEQ ID NO: 334455 - DNA, 654 bp, Homo sapiens
  misc_feature: GZ8MTXP02FPMZT.25.35.D02.1.454.CMB.2.raw
  modified_base (222)..(222): a, c, t, g, unknown or other
  misc_feature (222)..(222): n is a, c, g, or t
  modified_base (446)..(446): a, c, t, g, unknown or other
  misc_feature (446)..(446): n is a, c, g, or t
  modified_base (486)..(486): a, c, t, g, unknown or other
  misc_feature (486)..(486): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcgggaggtcgggggnggaaacggtggtccgaggccgggagtccctgagactctcctgtgcagtgtccgcgtccaccttccgtcgtttcggctattcacgtcggtccgccgacggtcctccgaggaccgaagggaccgtgggaggtggggtcgggtcggtcgagtagtggtgggagtaggaagtaagtgtacttatttgtgcgtagaccgtccggtaggaacggggcctacgtcaacccngtaccacgagaggcacgacctacaaacgtaccttactttntccatacaagttacgaaacgtcgagtacgtacgacgactaacggtcgtacttacttaacgttcgttcgggacggtacccgggtataaccggaaagggtaacccggtaacgggggttaccggggtacccttaacgggtacccggaagtccgggttacggaaccccgggg

SEQ ID NO: 334456 - DNA, 634 bp, Homo sapiens
  misc_feature: GZ8MTXP02G8A9D.25.35.D02.1.454.CMB.2.raw
  modified_base (390)..(390): a, c, t, g, unknown or other
  misc_feature (390)..(390): n is a, c, g, or t
  modified_base (470)..(470): a, c, t, g, unknown or other
  misc_feature (470)..(470): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactgggcggaggtcgggggagcggtggtccgaggccggggaatccctgagcctctcctgtgcagtcgtcccgtcgtcccaccgtttccgtcgttttcggctatttccacgttgggtccccgcctagggccctccgaacgggctaaaacggggctgggaggtggggtggccgggttacagtaagttgggnggggattgggaaacgttaatggtacttagttttagcgcgaacgtaccgtccgtggaaaacgggtccgaaactcaaacccntacacgagacgacgacgaccaacgaaactaacttactttacacgtacgtactaagttaacggaaaccgtgaacgtacgtacgaacacgacgtctactctacgttacgcggtcggcggtacaagaacgaccggaagggtccgggactcggacgcgtacgcggccg

SEQ ID NO: 334457 - DNA, 603 bp, Homo sapiens
  misc_feature: GZ8MTXP02GLZRF.25.35.D02.1.454.CMB.2.raw
  modified_base (381)..(381): a, c, t, g, unknown or other
  misc_feature (381)..(381): n is a, c, g, or t
  modified_base (455)..(455): a, c, t, g, unknown or other
  misc_feature (455)..(455): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatccctgagactctcctgtgcagtcgtccgcgtcctaccttccgtcgtttggctattccacgtcggtccgccaggcctccgaggccaaggggctgggagtggggtgcggtcagtagtggtggatggaatatgcttaatttgngctagacctccggtagaacgggccactcacctatccacgagtacgcagcctaccgaagtaaccttaccttttancgtactactaacgttaacggaaaccgtgaacgtacctacgaacgaccggtacgtcttacgtactacgttaccgtcggacggtcgggtacaacggaacgtaaccgggtcgggtcccgggtacgttcggacggcgtacggtacgggaccg

SEQ ID NO: 334458 - DNA, 621 bp, Homo sapiens
  misc_feature: GZ8MTXP02JJ391.25.35.D02.1.454.CMB.2.raw
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (487)..(487): a, c, t, g, unknown or other
  misc_feature (487)..(487): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcggggggagcggtggtccgaggccggggaagtccctgacgactctccgtgtgcngtcgtccgcgtccaccttccgtgtttggactattcacgtgggtcccnccgaggtcctccgaggcaagggactgggaggtggggtggcggtcagtagtgggtgggacgtggaaacgtatggtactagtttttaacgngacgtagtaccgtacgtaggacgggcctactacacctacnccctacgagacgacacgacctaacgtaactaaccttactttancgtatacgtaaacgtacgaaacgtgacgtacgacgacgtacgcgtactgtactacgtacgtcgggcggtaggtacaacggaacggacggtcggggtccggtacctacggacggtcgtacggtcggaccggtcgg

SEQ ID NO: 334459 - DNA, 758 bp, Homo sapiens
  misc_feature: GZ8MTXP02IP9MA.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgtcttcttttaagaggttgtccagtgtcagatgacaacgtgggcggagggtcggggggagtcgtggtccgaggccggggtaagtccctagacgtacctctctgtcgctaggtcgtccgctcctaccttcgttcgtttgctacttcgacgtcgggtcctccgaggtccctcgagggaccgaaggggtactggggtagttcgggggtgtaccgggtctaagttaggtggggtagggtagtagggtaaagttaattcggtaactttagtttttacgcgactacggttacccgttcccggtaagggaaaccggggtccctacgtccgaaaccctgtacccgaccaagggtacgacccgaacgtaccttaacccgaaaataaccctttaaccttttacttacgacgttaaactaaacgtttaaccggaaaacccggtgtaaccgtaaccgttaccggaaaccgtacggtaaccgttcgttacctttacgttaacgtttaccgcgggttaccgggtcgggttacgtaaacggacgtaaacgggtccggggttacccgggcttacgggtacccggagtacggtacgggacccggg

SEQ ID NO: 334460 - DNA, 791 bp, Homo sapiens
  misc_feature: GZ8MTXP02G758H.25.35.D02.1.454.CMB.2.raw
  modified_base (185)..(185): a, c, t, g, unknown or other
  misc_feature (185)..(185): n is a, c, g, or t
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggtttttcctcgtttgcttcttttaagnggtgtccagtgtcagatgacaacgtgggcggaggtcgggggagcgtggtccaggccgggaatccgtgagctctctgtgcngtcgtccgcgtcctcgttccgtcgtttgctattcncgtcggtccncaggcctaccgaggacgaagggcgtgggaggtcggggtagccggtanagttaggtggggtagggtaatacgggtaaagttagtggtacttaagtttttacgcgtaccgtaaaggtacccgttaccggggtaagggaaaccgggggtccccaaaccgttccaaaccccgtagttacccgacccggaaagggaccgggcctaacggtccctaaaacccgaaacgttaaacccttaacccgtttttatacccgtaggtaaaccttaaagttaaaccgggtaaaaccggtgaaacgttaccccgtacgggaaactacccggtacgggtacttacggtttaaacccttaacgggttaccgtcgggggaccggggttaccggggttaacgtaaacgggaaacgggtaacccgggggtaacggggggttccccggtaaaccggttaccggaccgggtacggacgggtttacccgggggaaccccgggg

SEQ ID NO: 334461 - DNA, 658 bp, Homo sapiens
  misc_feature: GZ8MTXP02HR61Q.25.35.D02.1.454.CMB.2.raw
  modified_base (185)..(185): a, c, t, g, unknown or other
  misc_feature (185)..(185): n is a, c, g, or t
  modified_base (501)..(501): a, c, t, g, unknown or other
  misc_feature (501)..(501): n is a, c, g, or t
  modified_base (588)..(588): a, c, t, g, unknown or other
  misc_feature (588)..(588): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggtttttcctcgttgcttcttttaagnggttgtccagtgtcagatgcaacgtgggcgggagggtcgggggggaggcgtgggtccgagggccggggaagtcccgtggagaccttctccctgtgcaggtcgtccgccgtccctaccgtttcccggtcgtttttacggcctattccacgtcgggtcccgccagggcctccgaggccaagggctgggaggtgggtgcggtctagtagtgggtcggggatagggaaatagtcgtcgttattttgcggctaggtacctccgggtaggaacggggtcccacctacacctatcctccagtacggcacggtcctaccgaaanacccttactttatcctaggtacccttaagttacggaaaacccgtgaacggtacctacgaacgacgtagtcctagttactacgttacncggtcggtacgggtcaaggaacgtaacggcggggttaccgggccgttcgacggtacacgtacgggaccgg

SEQ ID NO: 334462 - DNA, 647 bp, Homo sapiens
  misc_feature: GZ8MTXP02FMD92.25.35.D02.1.454.CMB.2.raw
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
  modified_base (632)..(632): a, c, t, g, unknown or other
  misc_feature (632)..(632): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccaggccgggaatccctgacgactctctgtgcagtcgtccgccgtccaccttccgtgtttcgctatcacgtggtcccncaggctccgaggacgaaggcgtggaggtgggaggcgtcatagtggtcggataggaagtactgtactattttagngacagtaccgtccggtaaggaacgggtacccgtactaccaaccctacttccgaccgaggaacggcctaacggacccttaaccgaaaacctaacctttaaaccttttactacgtacgtaactaacgtttaaacgaaaacgtcgtaacgacgtaccgacgacgtacgtcttagtactagttacgcggtacggtacgggtactaaaggaacggtaaccggtaacggggtcccgggaccgttacgacgggtacncggtacggacccggg

SEQ ID NO: 334463 - DNA, 672 bp, Homo sapiens
  misc_feature: GZ8MTXP02JGRF2.25.35.D02.1.454.CMB.2.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (412)..(412): a, c, t, g, unknown or other
  misc_feature (412)..(412): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccgaggccgggaagtcccngacgctctcctgtgcngtcgtccgcgtccaccgttccgtcgtttgctattcacgtcggtccgccgacggcctcccgaggcgaacggggacgtgggtaggtggggtggtcggtcgtagtaggtgggtagggtagtagggtaagttaagtgtacttaagttttgngtactacgtaccgtccggtagggaaacgggccctaaccgtccgaaccctatccgtacccgagacgccgtacgacctacccgaaacgtaacccttacttttacaccgtagtaaccgtaaagtttaacgaaaaccgtgaacgactaccggacgacgtacggcttacgtactacgttacgcggtcgggtaccgggtctaacggaacggaacggtccggggtaccggggtccctacgggtacggacgtacggtacggacccggg

SEQ ID NO: 334464 - DNA, 704 bp, Homo sapiens
  misc_feature: GZ8MTXP02IQPBE.25.35.D02.1.454.CMB.2.raw
  modified_base (247)..(247): a, c, t, g, unknown or other
  misc_feature (247)..(247): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggactcccgggctcagtctgccctgactcagcctcgctcagtgtccgggtctcctggacagtcagtccaccatcctcctgcactggaaccagaagtgattcgttggtntacttatgacactgtctctgctacctacgtttacccaagtaaacgcccccagacgtacacttaccttactgactgtacaggaacgcgccgtcgacgggtcctcgactccgtacttctcgtcggtacctaatcgtgtaccacgacccgtcctccgtacgacctacgttctccggtcggcctccggtaacggtcgttacggaaggtacgtacgggacgggtcctttaaggttaacgttttaagtttaacgtttcggtaccgtttagggttaccctaaagtttacgtacggtaacggtaacgggtaacctttaaacgtacgtttaacggttttacgggttaccggtttccgggtaccggtaccgggtaaaccgggtaaaccgttaaccgggttacccgtaacccggttccggtacggttaccgaccggacccggtaacggtcccgtacccgttcccccgg

SEQ ID NO: 334465 - DNA, 723 bp, Homo sapiens
  misc_feature: GZ8MTXP02GNN3Z.25.35.D02.1.454.CMB.2.raw
  modified_base (318)..(318): a, c, t, g, unknown or other
  misc_feature (318)..(318): n is a, c, g, or t
  modified_base (401)..(401): a, c, t, g, unknown or other
  misc_feature (401)..(401): n is a, c, g, or t
  modified_base (601)..(601): a, c, t, g, unknown or other
  misc_feature (601)..(601): n is a, c, g, or t
  modified_base (693)..(693): a, c, t, g, unknown or other
  misc_feature (693)..(693): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtgggcgggaggtcgggggagcgtggtccgaggccggggaatccctgacgactctcctgtgcagtcgtccgcgtccctaccgttccgttcgtttgctacttcacgtcgggtcccncgaggctccgaggaccaagggctgggaggtggggtgcggtcagtagtggggtaggagtaggaaagtatggtacttagttttancggtacaggtaccgtccggtaggaaacggggcccgtactcccgaacctacgttccgaccgaggacgcgtaacgactaacccgaaagtaacccttaccttttaaactccgttacgaacttaaaacgtacggtaaaaacccgtgaacccgtaacgtaccggaacgtaaccgacggtaccgtagttaccttaagttaaccggnggtaaccccggggtgggggttaactaacgggaaaaccggtaaacggtccgggggtaacccgggggtccccgttaaacggttaccccgggtanaaccgggtccgggggtaaccggcccggggg

SEQ ID NO: 334466 - DNA, 611 bp, Homo sapiens
  misc_feature: GZ8MTXP02FHIWK.25.35.D02.1.454.CMB.2.raw
  modified_base (165)..(165): a, c, t, g, unknown or other
  misc_feature (165)..(165): n is a, c, g, or t
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (482)..(482): a, c, t, g, unknown or other
  misc_feature (482)..(482): n is a, c, g, or t
  modified_base (507)..(507): a, c, t, g, unknown or other
  misc_feature (507)..(507): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttccncgttgctnttttaaagnggtgtccagtgtcagatgcaacgtggcggaggtcgggggagcgtggtccaggccggggaatccctgagcctntccgngtgcagtcgtccncgtccaccttcgtcgtttaggctatcgacgtgggtcccgcagggcctccggaggtcgaaacgggtactggggagtggggttgggccggttcaagttgtggggtccgggataggggaatatgacttagtttttncggcaaagtccgttccgaggaacgggccctacncaccattcnccagacgcagacctacaaacgtaacctccgtttanctcgacaacgttacgaaaacggttnacggtacacgacgaccgacggctcgtactactcgtcggcggacgggtcgacgaaaaggccggaacgggttcgggccgttacgacggtcgaacgtcgggacccgg

SEQ ID NO: 334467 - DNA, 667 bp, Homo sapiens
  misc_feature: GZ8MTXP02JB1CR.25.35.D02.1.454.CMB.2.raw
  modified_base (516)..(516): a, c, t, g, unknown or other
  misc_feature (516)..(516): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccaggccggggaagtccctgacgactcgtcctgtcgcgagtcgtcccgcgtcccaccgtttccggtcgttttcggcctattccgaccgttcggggccccgccagggtccctcccgaaggaccgaaaggggtcgtggggagggttggggtggccggtcaagttacggtggggtagggagtcgggaaagttaatggtacttagtttttagcgacgagtaccgtcggtaggaaacgggcctactcgacactcaccgagacgcacgcctaccaaagtaccttacctttanccgtagtactaaagttacggaaacgttgaacgtacgtacgaacgacgacgtctacgtacttaacgtggcggtacggacgggttcaacggtaaccgtaacgggtcgggtacccggggtacctacgggaccgtcgacgggttacgggacccgg

SEQ ID NO: 334468 - DNA, 629 bp, Homo sapiens
  misc_feature: GZ8MTXP02GRTUN.25.35.D02.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggtggagtcgtgggggagtcttggacagccgaggccgtcctgacnctctcngcacngctcgactcacgtttgnagcatgctatcgtaccgtcgggtacccnccgaggtcctaccggaaggggtaacgggttcctagggagttcggtccgttttagggtacccaagtttaacgaacggacgtaacggtccgttaagtcgggggtagggaccaaacgacgaacgtcgccgtacgtactaaggtaaaagctaagacttacgacgcctacgtacaaagagtatacgtaacttaaccaaaaggtcacgtaccgactaacttcagactacgaatcgacgacacggtacctaggaaacgaaacggccggaacggacctacgacgtcgttaacgttacgtttacttagtttactttaacgttaacttcgg

SEQ ID NO: 334469 - DNA, 598 bp, Homo sapiens
  misc_feature: GZ8MTXP02FM0I2.25.35.D02.1.454.CMB.2.raw
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (454)..(454): a, c, t, g, unknown or other
  misc_feature (454)..(454): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccgggggaagtccctggagactctcctgtgcagtgtccgcgtccaccttccgtcgtttggcattcactgggtccncaggctccgaggcaagggactggagtggggtggcggtcatagtggtgggatggaatatgctattttgngacagtacgtcgagacggccctacncacctatccacgagacgcacgtaccctaacgaaacgtaaccttaccgttttancgtacgtaactaattaacggaaaaccgtgaacgtactaccgaacgacgacggtctacgttactacgttacgcggcggtacgggtacgacggaacgaacggtaacggggtccgggaccgtacggtaccgacgacggtcggaccgg

SEQ ID NO: 334470 - DNA, 641 bp, Homo sapiens
  misc_feature: GZ8MTXP02H7LZ4.25.35.D02.1.454.CMB.2.raw
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtcagtgtcagatgcaactggcggagtcgggggagcgtggtccagccgggaatccctgagactctcctgtgcagtgtccgcgtccaccttccgtcgtttggctattcactgggtccnccaggtcnccaggcaaaggggtactgggagtggggtcgcggtacatagtggtgggatgggaaataatcgacatttttancgacacgactacgtacgacggacgactacacactctcgagacgacgacgacgtaccaacgaaaccttaaacctttaacttacgttacgtaactaaagtaaacgtaaaaccgtaacgtaacgaaccgtaccgaccgaaccgtaaccggtacgtacgttacgttaacgttacgttacggtacggtaccggggtacgtaacggtaaacggaaacggaacgggtacggggtaccggtaccggtaacggacgtaacgtacggacgg

SEQ ID NO: 334471 - DNA, 758 bp, Homo sapiens
  misc_feature: GZ8MTXP02F80MP.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcgttgggttttcctcgttgcttcttttaagaggtgtccagtgtcaggatgcaacgtggcgggaggtcgggggagcgtggtccaggccggggatcccgtagacgtctctcgtgagcagtcgtccgcgtcctaccttccgtcggtttgctacttcgacgtcgggtcccgccaggcctacccgaggaccgaagggtctaggggagtcggggtggacggttcaggttcgtaggggtggtacgtaggaaagttactggtaacttagttttacgacgtacgtaacggtacccgttacgggtaaggggaaccggggtaccccctaacgtacccgtaacccgtaacgttacccgacccgaaggggtaccgacccgtaagtaccccgtttaaaccgaaaacggttaccctttaaaccgttttacggacccttaggtaacccgttaaaagtttaacgggaaaaccgttcggtaaactacccggttacgaaccggaacgtaccgggtctaacgttacgttaacgtaccggcggtacgggtacggggtacgttaaacggaaggtaaacccggtcggggtccgggacccgttacggacggactacggtcggaacccgg

SEQ ID NO: 334472 - DNA, 646 bp, Homo sapiens
  misc_feature: GZ8MTXP02H05J9.25.35.D02.1.454.CMB.2.raw
  modified_base (414)..(414): a, c, t, g, unknown or other
  misc_feature (414)..(414): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagactgtacagtcacgaccggtgctcgatttagcacacgatagttgggtttggggagctctgggagaggagcccagcactagaagtcggcggtgtttccatccggtgatcagcactgaaacacagaggactcagcatggagtttggggctgcgcttgggttttccctcgttgcttctttttaagaggtgtccagtgtcagatgcaactggcggaggtcggggggaggcggtggtccaggccgggggaacgtcccgtggacgactctccgtgtcgcagtcgtccgcgtccctaccgttccgttcgtttcggctagttcacgtcgggtccgccacggctccgaaggaccaagggctggaggtgggtggcgtcagtagtgggtgggactaggaaataacgtggacttattttagngtacacgaccgtcgtacggaacggtccgactcacactactcagagcacgctacaacgaacctactttacncttnactaatacgaaaacgtgaagtaccgtacgaacgacgacgtcgtagttacgtacgtttacgacggtacgggtacggggttactaacggaacggtaacggtaacgggggtccggggtacccggttacggtaccggtacgtacggttacgggaccccgggg

SEQ ID NO: 334473 - DNA, 767 bp, Homo sapiens
  misc_feature: GZ8MTXP02FI9FL.25.35.D02.1.454.CMB.2.raw
  modified_base (182)..(182): a, c, t, g, unknown or other
  misc_feature (182)..(182): n is a, c, g, or t
  modified_base (248)..(248): a, c, t, g, unknown or other
  misc_feature (248)..(248): n is a, c, g, or t
  modified_base (657)..(657): a, c, t, g, unknown or other
  misc_feature (657)..(657): n is a, c, g, or t
tcagactgtacagtcacgaccggtgctcgatttagcacacgatagttgggtttggggagctcgtgggagaggagcccagcactagaagtcggcggtgtttccatccggtgatcagcactgaacacagaggactcagcatggagtttgggctgcgctgggttttcctcgttgctcttttaagnggtgtccagtgtcagatgcaactggcggaggtcgggggagcgtggtccaggccggggatcccgtgngactctccgtgtgcagtgtccgccgttccaccttccgtcgtttggctagttcctacgtgggtccgccgaggtcctccgaggaccgaaaggggtcctggggaacggtggggtacggggtcggttacagttacgtggggtacgggtagtaggggaaagtttaacgtggtaccgttaagtttttacgcggtaccgtaacggtaacccgttcccggggttaacgggaaaccggggtccccgtaaaccttaccccgaaacccgtccgttaacccgtcccgaagggaccggtacaacgggtaccctaacccgtaaaacgaaaccctttactttttaaacgaccgtttagaacttaaacggttacggaaaaacccgttgaaacgtaccgtacgaaaccggtacgaccgggtacccnggttactaaacgttcgttcgggacggtaccggggttacaacgggtaagtaaccggtaacggggtccggggtacccgttacggtaccggacgtacggtcgggaaacccggg

SEQ ID NO: 334474 - DNA, 475 bp, Homo sapiens
  misc_feature: GZ8MTXP01CB8VO.44.25.C03.1.454.CMB.2.raw
  modified_base (368)..(368): a, c, t, g, unknown or other
  misc_feature (368)..(368): n is a, c, g, or t
  modified_base (472)..(475): a, c, t, g, unknown or other
  misc_feature (472)..(475): n is a, c, g, or t
tcagacagtatatacacgaccggtgctcgatttagtagtgtagatttgggtttgggctggatccgtcagccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatggacgggaaagaaacagctggtttctgtattataagtcttaccatctggacgtctggggcaaagggaccacggtcaccgtctcctcagcttccaccaagggcccatcggtctcccctggcncctgctccaagagcacctctggggcacagcggccctggggctggccctggtcaaggactacttcctatatactgtctggaggcggggctggcaaggcgcatagnnnn

SEQ ID NO: 334475 - DNA, 549 bp, Homo sapiens
  misc_feature: GZ8MTXP01CAUPX.44.25.C03.1.454.CMB.2.raw
  modified_base (282)..(282): a, c, t, g, unknown or other
  misc_feature (282)..(282): n is a, c, g, or t
  modified_base (363)..(363): a, c, t, g, unknown or other
  misc_feature (363)..(363): n is a, c, g, or t
tcagacagtatatacacgaccggtgctcgatttagtagtgtagatttgggtttgggggcctgggcctcaggaagcagcatcggaggtgcctcagccattgcatggatccctctcttcctcggcgtccttgcttactgcacagggtccggggcctcctctgacctgactcagccatcctcactgtccgtgtccccaggacacacagtcactattacctgctctaggggaaacttgagtgataaattgcttcctggtatcagcagaggcaggccagccccctangctggtcatctttcaggataataagcggccctcgagggatcccgtgagcgcttctcctggctccaactcgtacgggaaccncggccactctcgaccatcagccgcgacccagcctagtcggatgaggcctgactattactgtacgaggacggtgggaaagtgacgtaagttggggtgttcggcgggagggaccaaggctggttaccgttcgttcgggtcacggcccgagggcctcgcccctggtccacttctccgttccctaacccc

SEQ ID NO: 334476 - DNA, 464 bp, Homo sapiens
  misc_feature: GZ8MTXP01DW6E0.44.25.C03.1.454.CMB.2.raw
  modified_base (458)..(464): a, c, t, g, unknown or other
  misc_feature (458)..(464): n is a, c, g, or t
tcagacagtatatacacgaccggtgctcgatttagtagtgtagatttgggtttggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggacgggaccaagctgaccgtcctgggtcagcccaaggctcgccccctggtcactctcgttcccaccctcctctactactactgtctgacgcgggctggggcaaggcgcatagnnnnnnn

SEQ ID NO: 334477 - DNA, 377 bp, Homo sapiens
  misc_feature: GZ8MTXP01BIEET.44.25.C03.1.454.CMB.2.raw
  modified_base (374)..(377): a, c, t, g, unknown or other
  misc_feature (374)..(377): n is a, c, g, or t
tcagacagtatatacacgaccggtgctcgatttagtagtgtagatttgggtttgggggctgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttccccacctcctctatatactgtctgagcgggctggcaaggcgcaatagnnnn

SEQ ID NO: 334478 - DNA, 462 bp, Homo sapiens
  misc_feature: GZ8MTXP01A6SET.44.25.C03.1.454.CMB.2.raw
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (454)..(462): a, c, t, g, unknown or other
  misc_feature (454)..(462): n is a, c, g, or t
tcagacagtatatacacgaccggtgctcgatttagtagtgtagatttgggtttggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgaggtgattatactgccagtcctatgacagcagcctcagtggttgggtgttcggcggaggaccaagctgaccgtcctgggtcagcccaagcctcgccccctggtcactctcgttccccacctcctctactatactgtctgagtcgggctggggcaagggcnctangnnnnnnnnn

SEQ ID NO: 334479 - DNA, 458 bp, Homo sapiens
  misc_feature: GZ8MTXP01BXN1K.44.25.C03.1.454.CMB.2.raw
  modified_base (451)..(458): a, c, t, g, unknown or other
  misc_feature (451)..(458): n is a, c, g, or t
tcagacagtatatacacgaccggtgctcgatttagtagtgtagatttgggtttggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattatactgccagtcctatgacagcagcctcagtggttgggtgttcggcggaggaccagctgaccgtcctgggtcagcccaagggcctcgccccctggtcactctcgttcccacctcctctatatactgtctgagcgggctggggcaaggcgcatgnnnnnnnn

SEQ ID NO: 334480 - DNA, 551 bp, Homo sapiens
  misc_feature: GZ8MTXP01BUXQH.44.25.C03.1.454.CMB.2.raw
  modified_base (544)..(544): a, c, t, g, unknown or other
  misc_feature (544)..(544): n is a, c, g, or t
tcagacagtatatacacgaccggtgctcgatttagtagtgtagatttgggtttggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctctttacgacgtcctttcgcgggcttcggcagtccctgccgttttcggcctcagttctgaccacgcggcctcctcgaccatcaccaaactccgcctgagatgagctgactactttgtgtgcattattcgattcatacaaattatgtcttcggaaggtcgggaccgcgtcagcgtcctgaccgtcacgcccaacggcccaaccccacttgtcactctcgttcccacccttctctatctactgttctgngtccggg

SEQ ID NO: 334481 - DNA, 458 bp, Homo sapiens
  misc_feature: GZ8MTXP01AC1JN.44.25.C03.1.454.CMB.2.raw
  modified_base (303)..(303): a, c, t, g, unknown or other
  misc_feature (303)..(303): n is a, c, g, or t
  modified_base (451)..(458): a, c, t, g, unknown or other
  misc_feature (451)..(458): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgaggtgattattacngccagtcctatgacagcagcctcgagtggttggtgttcggcggacggaccagctgaccgtcgtgggtcagcccaggctcgccccctggtcactctcgttcccaccctcctctatactactgtctgagcgggctggggcaggcgcatgnnnnnnnn

SEQ ID NO: 334482 - DNA, 476 bp, Homo sapiens
  misc_feature: GZ8MTXP01B6U7C.44.25.C03.1.454.CMB.2.raw
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (466)..(476): a, c, t, g, unknown or other
  misc_feature (466)..(476): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagccctccctggccatcactgggctccaggcngaagatgaggtgattatactgccagtcctatgacagcagcctnagtggttggtgttcggcggaggaccagcgtgacccgtcgtgggtcaggcccaacgggctcggccccctggtccacttctcgttccccaccctcctctattactactgtctgaggcgggctggggcgaaggccgacatagnnnnnnnnnnn

SEQ ID NO: 334483 - DNA, 464 bp, Homo sapiens
  misc_feature: GZ8MTXP01AZEAE.44.25.C03.1.454.CMB.2.raw
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
  modified_base (449)..(464): a, c, t, g, unknown or other
  misc_feature (449)..(464): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggcngaagntgaggtnattatactgccagtcctatgacagcagcctnagtggttggngttcggcggacggaccagctgaccgtcgngggtcagcccaggcctcgcccctgtcactctcgttccccncctctctatctctcgtcngcggcgcgcggggacgaggcgacatgnnnnnnnnnnnnnnnn

SEQ ID NO: 334484 - DNA, 518 bp, Homo sapiens
  misc_feature: GZ8MTXP01E1JRA.44.25.C03.1.454.CMB.2.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
  modified_base (472)..(472): a, c, t, g, unknown or other
  misc_feature (472)..(472): n is a, c, g, or t
tcagacagtatatacacgaccggtgctcgatttagtagtgtagatttgggtttgggcacaagaggcagcactcaggacaatctccagcatggcctggtctcctctcctcctcactctcctcgctcactgcacagggtcctgggcccagtctgtgctgacgcagccgccctcagtgtcgtggggccccgggnagaggtcaccatctcctgcactgggancagctccaatatcggggccagattatgatgtgcactggtaccagcaacttccaggaacacgcccccaaactcctcatctatggtaacaacaatcgcccctnacggggtccctgaccccgattctctgccctccaagtctggcacttcagcctcctggccatcactgggcctccagcctgaggatgaggcggattattactgccagtcgtcgaagagattcgggcggagggactaagctgaccgtccttaggtcncgcccgaggcctcgccccctggtccacgttctcgttccccaacccc

SEQ ID NO: 334485 - DNA, 682 bp, Homo sapiens
  misc_feature: GZ8MTXP01CLJMH.44.25.C03.1.454.CMB.2.raw
  modified_base (285)..(285): a, c, t, g, unknown or other
  misc_feature (285)..(285): n is a, c, g, or t
  modified_base (382)..(382): a, c, t, g, unknown or other
  misc_feature (382)..(382): n is a, c, g, or t
tcagacagtatatacacgaccggtgctcgatttagtagtgtagatttgggtttggggctgggcctcaggaagcagcatcggaggtgcctcagccatggcatggatccctctcttcctcggcgtccttgcttactgcacgaggggtccggggcctcctctgacctgactcagccatcctcactgtccgtgtccccaggacacacagtcactattacctgctcgtaggggaaacttgagtgaataaatttgcttctggtatcagcagacggcaggccacgcccctangctggtctatctttacgaggtataaagtaacggcggccctcgagggtactcccgtgacgtcgcttctccgtcggtctccaactcgtaacgggaaccncggccacgtctacgaccactcgacgcgccgaccacgcctcgtcggagtacggacggtcgtacggtacttaacgttacgtacggtacggtaacggtaacgggtaacggggtaaaggtacggtacgttaacgggtttagggggttagggttaccccccggggaggggtaaccggggaccgtaacggtccggtacggttacccggttccggttaccggttaccgaccggacccgttacggttcccgttaacccggtccccgttccggtcccgtaccgttcccgttccggttccccgttccccg

SEQ ID NO: 334486 - DNA, 542 bp, Homo sapiens
  misc_feature: GZ8MTXP01DCV7T.44.25.C03.1.454.CMB.2.raw
  modified_base (262)..(262): a, c, t, g, unknown or other
  misc_feature (262)..(262): n is a, c, g, or t
  modified_base (337)..(337): a, c, t, g, unknown or other
  misc_feature (337)..(337): n is a, c, g, or t
  modified_base (476)..(476): a, c, t, g, unknown or other
  misc_feature (476)..(476): n is a, c, g, or t
tcagacagtatatacacgaccggtgctcgatttagtagtgtagatttgggtttgggggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaacttgagtgataaattgcttctgtatcagcagagcaggccagcccctangctggtcatcttcaggataataagcggcctcgagggatccctgagcgtcttctctggctccaactccgtggaacncggccactctcgaaccatcacgcgaccgacccagcctcgtggactggaggcttagacttattactgtacagacgtagggaaacgtggacttaaggttgggtcgttcgggcgagggaccaagctgaccgttctcgggtcncgccgacggctccggccccttacggttcaccttccgtacttcccaccctcttactgttaacttccg

SEQ ID NO: 334487 - DNA, 640 bp, Homo sapiens
  misc_feature: GZ8MTXP01CSFNB.44.25.C03.1.454.CMB.2.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (321)..(321): a, c, t, g, unknown or other
  misc_feature (321)..(321): n is a, c, g, or t
tcagacagtatatacacgaccggtgctcgatttagtagtgtagatttgggtttggggatctcaggaggcagctctctcggaatatctccaccatggcctgggctctgctcctcctcaccctcctcactcagggcacaggatcctgggctcagtctgccctggctcagcctccctcgtgtctggttctcctggacagtcgatcaccatctctgcacgtgggtccagcaatgactagttggganatataacttgtctcngtatcaacacatccaggacaaacgcccccaaatcattacttttgacgtccagtgagcggccgtntaggttgtttactaactcgtcttctcgtggcctccaagtcctggcccacgaccggccctcctgtcgtatcgtcgtcggcctccggcgttggaggtgtggacggtctacgtacttacgttacgtggtccggtacttacgttaactttaacctaacgtttccgttagtaacggttaccggtttgggggttcgggtttcggggacggggttaggggtacccttacccgtacccgtcgggttaaccccggttccggttaaacgggtccgaacccggtcccgtaacgggtcccgttacccggtccccccgttcgggttaacccc

SEQ ID NO: 334488 - DNA, 466 bp, Homo sapiens
  misc_feature: GZ8MTXP01DFSLD.44.25.C03.1.454.CMB.2.raw
  modified_base (296)..(296): a, c, t, g, unknown or other
  misc_feature (296)..(296): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (456)..(466): a, c, t, g, unknown or other
  misc_feature (456)..(466): n is a, c, g, or t
tcagacagtatatacacgaccggtgctcgatttagtagtgtagatttgggtttggaggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcacgccctcctggccatcactgggctccaggctgaagatgagggtnattatactgccagtcctatgacagcagcctcaggttggttgggtgttcggcggaggacagctgaacccgtctgggtcacgcccaagcctcgcccctgtcnctctcgtcccncctcctctatctactgtctgacgcgggcgtggcgaacggcgacgatagnnnnnnnnnnn

SEQ ID NO: 334489 - DNA, 556 bp, Homo sapiens
  misc_feature: GZ8MTXP01DALJ5.44.25.C03.1.454.CMB.2.raw
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (535)..(535): a, c, t, g, unknown or other
  misc_feature (535)..(535): n is a, c, g, or t
  modified_base (542)..(556): a, c, t, g, unknown or other
  misc_feature (542)..(556): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggcctcaagtctggcacctcagccctcctggccatcactgggctccgaggcngaagntggagggtgatttattactgccctagtccctagtcgacagcagtcccctgaggttgggtttgggtagttcgggacggggaacgggacccaaggtccgtacggaccccggtccgtgggtccgacggtacccccgaaaggggtccctcccgcccccccgttgggtccctaccttccttccgtttcccccacccttcccttactaacttcttacttcgtcttcggacggcgggcgttggggcgaagggcncaagtgnnnnnnnnnnnnnnn

SEQ ID NO: 334490 - DNA, 457 bp, Homo sapiens
  misc_feature: GZ8MTXP02IGFDO.44.25.C03.1.454.CMB.2.raw
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
  modified_base (450)..(457): a, c, t, g, unknown or other
  misc_feature (450)..(457): n is a, c, g, or t
tcagacagtatatacacgaccggtgctcgatttagtagtgtagatttgggtttggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactggctccagctgaagatgaggtgattatactgccagtcctatgacagcagccctcgagtggttgggtgttcggcggaggaccaagctgaccgtcngggtcngcccaaggcctcgccccctggtcactctcgttcccaccctcctctatactactgtctgngcgggntcggcaaggcgcangnnnnnnnn

SEQ ID NO: 334491 - DNA, 481 bp, Homo sapiens
  misc_feature: GZ8MTXP02JQ01C.44.25.C03.1.454.CMB.2.raw
  modified_base (318)..(318): a, c, t, g, unknown or other
  misc_feature (318)..(318): n is a, c, g, or t
  modified_base (469)..(481): a, c, t, g, unknown or other
  misc_feature (469)..(481): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgaggtgattattactgccagtcctatgacngcagccctcagtggttgggtgttcggcggacgggaccagctcgaccgtccgtggggtcacgcccgaaggcctcgcccccctcgggtccacctctccgttccccaccctcctctatactactgtctgacgcgggctggacgaggcgcatagnnnnnnnnnnnnn

SEQ ID NO: 334492 - DNA, 461 bp, Homo sapiens
  misc_feature: GZ8MTXP02GCM6N.44.25.C03.1.454.CMB.2.raw
  modified_base (456)..(461): a, c, t, g, unknown or other
  misc_feature (456)..(461): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggcccatcactgggctccaggctgaagatgaggtgattattactgccagtcctatgacagcagccctcagtggttgggtgttcggcggagggaccaagctgaccgtcctgggtcagcccaaggctcgccccctggcactctcgttccccgccctcctctatactactgtctgagtcgggctggcaaggcgcatagnnnnnn

SEQ ID NO: 334493 - DNA, 577 bp, Homo sapiens
  misc_feature: GZ8MTXP02G5NJV.44.25.C03.1.454.CMB.2.raw
tcagacagtatatacacgaccggtgctcgatttagtagtgtagatttgggtttggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataattgcttctgtatcagcagaggccaggccagccccctatcgctggttatctttcaggataataagcggccctcgagggactccctgacgcgtcttctctcggctccaactctgggaacacggccactctcgaccatcagccgaccgacccacgtccctcgtggatgacggctgacttattactgtcaggtacggtagggaaagtgacttaagttggggtagttcgggacggagggaccgaagcgtacggtaccgttctcggtacacggtcccgaacgggtcctccggccccccgttcgggtccctaccgttccgttcccggtttcccccacccctttccc

SEQ ID NO: 334494 - DNA, 462 bp, Homo sapiens
  misc_feature: GZ8MTXP02JSJA2.44.25.C03.1.454.CMB.2.raw
  modified_base (294)..(294): a, c, t, g, unknown or other
  misc_feature (294)..(294): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (456)..(462): a, c, t, g, unknown or other
  misc_feature (456)..(462): n is a, c, g, or t
tcagacagtatatacacgaccggtgctcgatttagtagtgtagatttgggtttggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtnattattactgccagtcctatgacagcagcctcagtggttgggtgttcgggcggacgggaccaagctggaccgtcgtgggtcacgcccaaggcctcgccccctggtcactctcgttccccaccctcctctatatactgtctgagcgggctggcaggcncangnnnnnnn

SEQ ID NO: 334495 - DNA, 552 bp, Homo sapiens
  misc_feature: GZ8MTXP02FLR9I.44.25.C03.1.454.CMB.2.raw
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
tcagacagtatatacacgaccggtgctcgatttagtagtgtagatttgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaaaccacgacccccaaactcaatttatttatgcgtcaatgtcncccttcggtntccctgacgcgtcttctcgtcgggtccaagtctggccaacgcgcctcctgaccatctcgtgggcctccgagctgaggacgaggctgattattactgcagctacatatacaagtaggaactacgtttactattcggacgacgagggtacccaagctcgaaccgtccgtacggtcacgcccgaaggccgtcggccccctcggtcctaccgtcctcgttaccccc

SEQ ID NO: 334496 - DNA, 633 bp, Homo sapiens
  misc_feature: GZ8MTXP02JO89T.44.25.C03.1.454.CMB.2.raw
  modified_base (242)..(242): a, c, t, g, unknown or other
  misc_feature (242)..(242): n is a, c, g, or t
  modified_base (391)..(391): a, c, t, g, unknown or other
  misc_feature (391)..(391): n is a, c, g, or t
tcagacagtatatacacgaccggtgctcgatttagtagtgtagatttgggtttggggatctcaggaggcagctctctcggaatatctccaccatggcctgggctctgctcctcctcaccctcctcactcagggcacaggatcctgggctcagtctgccctggctcagcctccctccgtgtctggttctcctggacagtcgatcaccatctcctgcactgggtccagcaatgacattgggganagtataaccttgtctcctggtatcaacaacatcaggacaaacgaccccaaatcatacttttgagtccagtgagcggccgtcaggtgtttctaactcgtcttctctggctcagtctggcctacgacggccttcccgtgtccgactctcgngggtcctccggcctggaggactggagcttaggacttaattacgtgccgggtacttccctaagtttaccaaacctttgttacggacgtaaccgtttgggggttacgtttccgggggacggggtaacggggtaccttacggtacccgttacggaaccccggtttccgtaaacgggttcccgtaaccggacccccgaaaacggggtcccgtttacccggacccccccggtttgggttaacccccg

SEQ ID NO: 334497 - DNA, 744 bp, Homo sapiens
  misc_feature: GZ8MTXP02H6LHV.44.25.C03.1.454.CMB.2.raw
tcagacagtatatacacgaccggtgctcgatttagtagtgtagatttgggtttggggatctcaggaggcagctctctcggaatatctccaccatggcctgggctctgctcctcctcaccctcctcactcagggcacaggatcctgggctcagtctgccctggctcagcctccctcgtgtctggttctcctggacagtcgatcacatctctgcacgtgggtccagcaatgacagttggggagtatataaccttgtctcctggtatcaacaacatccaggacaaacgacccccaaatcattacttttgacgtccagtgagcggccgtcgaggtgtttactaatcgtcttctctggtcctaccgtagtcgttcggccctaccgaccggtccctcccgttcgtacccgtacttccgttccgtcggggcccgttcccgggtcccgttagggaacgggtagttacggggaacgggttccgttacgggtaaaccttttaacgtttaaccggttcggtcccggggtacctttacccggttaaatttttaaacccaacccgttttagttacggttaacggttaacggtttcgggggtttacggttttccgggggaccgggggtaaacgggggttacccttaccggtaaccccggttacggtaaccccggtttcccgtaacggggttcccgaacccgggaaccccggtaaacggggtccttaccccgggtccccccgtttccgggttaaccccg

SEQ ID NO: 334498 - DNA, 533 bp, Homo sapiens
  misc_feature: GZ8MTXP02HP7ZX.44.25.C03.1.454.CMB.2.raw
  modified_base (323)..(323): a, c, t, g, unknown or other
  misc_feature (323)..(323): n is a, c, g, or t
tcagacagtatatacacgaccggtgctcgatttagtagtgtagatttgggtttggggatctcaggaggcagctctctcggaatatctccaccatggcctgggctctgctcctcctcaccctcctcactcagggcacaggatcctgggctcagtctgccctggctcagcctccctccgtgtctggttctcctggacagtcgatcaccatctcctgcactgggtccagcaatgacagttggggagatataacttgtctcctggtatcaacaacatccaggacaaacgcccccaaatcatacttttgagtccagtgagcggccgtnaggttgttctaactcgcttctctggctcagtctggccacgacgccctcctgtcgatctcgtgggctccggctcgaggactgagctgacttattacgtgcgctctattacattctgagtacgttgggtcgtttcgggcgggtagggactcgtaaccgtcgaccgttcctagggtccgacgacccgagggcctccggaccccgttcggtccc

SEQ ID NO: 334499 - DNA, 631 bp, Homo sapiens
  misc_feature: GZ8MTXP02I5052.44.25.C03.1.454.CMB.2.raw
  modified_base (283)..(283): a, c, t, g, unknown or other
  misc_feature (283)..(283): n is a, c, g, or t
  modified_base (382)..(382): a, c, t, g, unknown or other
  misc_feature (382)..(382): n is a, c, g, or t
tcagacagtatatacacgaccggtgctcgatttagtagtgtagatttgggtttggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctcgtagggaaaacttgagtgaataaattgcttctggtatcagcagaggccaggccacgccccctancgctggtcattcctttcaggataaagtaacgccggaccctacgacgggtactcccgtgacgccgtcttctccgtcggcctaccaactcgtagggaaccnccgggccactctacgacctatcgacgccgacccgacccacgccctgtaggactcggaggtctagacttattaccgtgtacgaaggtaacgtagggaaacgtgaacgtttaaggttggggttacggttcggggacggggaacgggaaccaaaggtcgtacggtacccgttacgtccgggtacacggtacccgaaggtcccgtccgcccccgttacggtacctaccgtccgttacccgtacccctaccccg

SEQ ID NO: 334500 - DNA, 663 bp, Homo sapiens
  misc_feature: GZ8MTXP02IBXPJ.44.25.C03.1.454.CMB.2.raw
  modified_base (171)..(171): a, c, t, g, unknown or other
  misc_feature (171)..(171): n is a, c, g, or t
  modified_base (236)..(236): a, c, t, g, unknown or other
  misc_feature (236)..(236): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (455)..(455): a, c, t, g, unknown or other
  misc_feature (455)..(455): n is a, c, g, or t
tcagacagtatatacacgaccggtgctcgatttagtagtgtagatttgggtttgggcacaagaggcagcactcaggacaatctccagcatggcctggtctcctctcctcctcactctcctcgctcactgcacagggtcctgggcccagtctgtgctgacgcagccgccctnagtgtcgtcgggccccagggcaggagggtcagcatctcctgctagttgggagcggctaccaacgnggcggggctaggttttgatgttcagtggtaccagacactccgagacacgacccccaatcgctacatttacgactaaccactatcggccctgacggtccctagaccgtatccctacaggcctacgatccgtgcctacctnaccgtcccccttcccgnggacccacgtaccctccggcggtcctaccgaacggtctagggacgggacttggaaccgggttntagttaactttacgtaccgtacgtaccgaacgtaccgtagttacgaacgttaggttacgtacgtaggtacggttcggttcgggtttacgggggttccgggtacggggaccggggtaacggggaaccggttaacgggtaccggttaccgtaccggtaacggaccgaccggtacccggtaaccggtcccgtaccccggtcccggtacccg

SEQ ID NO: 334501 - DNA, 622 bp, Homo sapiens
  misc_feature: GZ8MTXP02F1XAZ.44.25.C03.1.454.CMB.2.raw
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
  modified_base (358)..(358): a, c, t, g, unknown or other
  misc_feature (358)..(358): n is a, c, g, or t
tcagacagtatatacacgaccggtgctcgatttagtagtgtagatttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggcaccatctcctgcactggagccagcgtaatnttcttagtcttacttgtctctgtatacantcataccaacggtaaaccaccccaaatcatctatctatgacgtctaagtacgacgtccctacgtagggtttactaagtcgtcgttacaccgtcncctacctaacggtccggaccaaaccgtccggtccctaccctacgaacctaacttctccgtcgcccgtacgtacggcgtacggaggacgacgtcgttagtaatttagttagttgtcgtacctagtagttagttcgttacgtcgactagttactaacgtttgtcgttacgtacggtacgtacggaccgtaacggtcgtaacccgtcgtacgtacgaccgacccgtaaccgccctaaccctacgttccgacctacgtccgttccccg

SEQ ID NO: 334502 - DNA, 594 bp, Homo sapiens
  misc_feature: GZ8MTXP02JAY9N.44.25.C03.1.454.CMB.2.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (406)..(406): a, c, t, g, unknown or other
  misc_feature (406)..(406): n is a, c, g, or t
tcagacagtatatacacgaccggtgctcgatttagtagtgtagatttgggtttgggggtgggcacaagaggcagcactcaggacaatctccagcatggcctggtctcctctcctcctcactctcctcgctcactgcacagggtcctgggccccactctgtgctgacgcagccgccctcagtgtctggggccccgggnagaggtcaccatctcctgcactgggancagactccaaanatcgggacagattcngatgccatggtaccaacacttccaaggaacacgacccccaaaatcctacgacttctttaggtaaaaccaacttaagtcccgggcccctcgaacggggtccctgaaccgtattcccctctggcttaccaagtctaggcacctcaagcccttcccgngaccatcacgtcggcctccgaggtctagaagtagtaggtagggtataattaacttactcgtactagtacctagtacgaacgacgacgacgctacgtaggtcggttgggttcggtcgggtacgggacggaacgaacgtacgtcgtaccgtccgtcggtacgacgaccgacgaccgtccgtacccgtccg

SEQ ID NO: 334503 - DNA, 560 bp, Homo sapiens
  misc_feature: GZ8MTXP02F8E0M.44.25.C03.1.454.CMB.2.raw
  modified_base (193)..(193): a, c, t, g, unknown or other
  misc_feature (193)..(193): n is a, c, g, or t
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagacagtatatacacgaccggtgctcgatttagtagtgtagatttggggtttggggggggtcacaagaggcagcgctctcgggacgtctccaccatggcctgggctctgctgctcctcactctcctcacccaggacacagggtcctgggcccagtctgccctgactcagcctgcctccgtgtctggggtcncctggacagtcggtcaccatctcctgcactggagccagcggtaatattcttagtcttaactttgtctcctggtatcaacatcatcaggtaaagcccccaaatcatcatctatgagcctaataagagccctnaggggtttactaatcgcttcactgcctcaacgtcggacaaacnccggcctcctagaccaatctctggactccagctcgagagacgntatattattagttgtntactnagttatgttcgtcnctatactactttatcgttacgtacggtaacggtacggtaaccgaagttcgaccgttacgtacggtaccaccgaccgaacgacccctaacccgtactcgtacctaccgttcttccg

SEQ ID NO: 334504 - DNA, 440 bp, Homo sapiens
  misc_feature: GZ8MTXP01AJKBH.2.30.C08.1.454.CMB.2.raw
  modified_base (433)..(440): a, c, t, g, unknown or other
  misc_feature (433)..(440): n is a, c, g, or t
tcagacgctcgacacacgaccggtgctcgatttagtctgacgtcaaagggaaggggctggagtgggtctcaagtattagtggtagtggcgttagcatgtactacgcagactccgtgaagggccggttcaccatatccagagacacttccaagaacacgctgcatctgcaaatgaacagtctgagagccgaggacacggccgtgtattactgtgcgaaagaatgggggacaggcgaagaataggcgatgcttttgacttctggggccaagggacaaaggtcaccgtctcttcagcctccaccaagggcccatcggtcttccccctggcacccctcctccaagagcacctctgggggcaccagcggccctgggctgccctggtcaaagggctacttcctgtcgagcgtctgagcgggctgggcaaggcgcatagnnnnnnnn

SEQ ID NO: 334505 - DNA, 433 bp, Homo sapiens
  misc_feature: GZ8MTXP02F6BHM.2.30.C08.1.454.CMB.2.raw
  modified_base (427)..(433): a, c, t, g, unknown or other
  misc_feature (427)..(433): n is a, c, g, or t
tcagacgctcgacacacgaccggtgctcgatttagtctgacgtcaaagggaaaggggctggagtgggtctcaagtattagtggtagtggcgttagcatgtactacgcagactccgtgaagggccggttcaccatatccagagacacttccaagaacacgctgcatctgcaaatgaacagtctgagagccgaggacacggccgtgtattactgtgcgaaagaatgggggacgaggcgaagaataggcgatgcttttgacttctggggccaagggacaaaggtcaccgtctcttcagcctccaccaagggcccatcggtcttccccctggcaccctcctccaagagcacctctggggcaccagcgccctgggctgcctggtcaaggactactcctgtcgagcgtctgagcgggctggcaggcgcatagnnnnnnn

SEQ ID NO: 334506 - DNA, 457 bp, Homo sapiens
  misc_feature: GZ8MTXP01A1KWH.11.22.B11.1.454.CMB.2.raw
  modified_base (380)..(380): a, c, t, g, unknown or other
  misc_feature (380)..(380): n is a, c, g, or t
  modified_base (452)..(457): a, c, t, g, unknown or other
  misc_feature (452)..(457): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatggagggagttacatggacgtctggggcaaagggaccacagtcatcgtctccgcagcttcaccaagggcccatcggtctcccctggcgccctgctccaggagcacctctgggggcacngcggccctggggctgcctgggtcaaggactacttccgtatctctcgctgagcgggctggcaaggcgcatagnnnnnn

SEQ ID NO: 334507 - DNA, 475 bp, Homo sapiens
  misc_feature: GZ8MTXP01BDKO8.11.22.B11.1.454.CMB.2.raw
  modified_base (390)..(390): a, c, t, g, unknown or other
  misc_feature (390)..(390): n is a, c, g, or t
  modified_base (468)..(475): a, c, t, g, unknown or other
  misc_feature (468)..(475): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatgggagggagttacatggacgtctggggcaaagggaccacagtcatcgtctccgcagcttccaccaagggcccatcggtcttccccctggcgccctgctccacggacgcacccgtctgggggccacgngcgggcccgtggggctgcccgtggtcaaggactacttccgtatctctcgctgacgcgggctggcaaggcggcagtagnnnnnnnn

SEQ ID NO: 334508 - DNA, 455 bp, Homo sapiens
  misc_feature: GZ8MTXP01AKNI1.11.22.B11.1.454.CMB.2.raw
  modified_base (385)..(385): a, c, t, g, unknown or other
  misc_feature (385)..(385): n is a, c, g, or t
  modified_base (453)..(455): a, c, t, g, unknown or other
  misc_feature (453)..(455): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatgggagggagttacatggacgtctgggggcaaagggaccacagtcatcgtctccgcagcttccaccaagggcccatcggtcttccccctggcgccctgctccaggagcacctctgggggcacngcggccctggggctgcctggtcaaggactactcgtatctctcgctgagcgggctggcaaggcgcatgnnn

SEQ ID NO: 334509 - DNA, 515 bp, Homo sapiens
  misc_feature: GZ8MTXP01EG5DT.11.22.B11.1.454.CMB.2.raw
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
  modified_base (495)..(495): a, c, t, g, unknown or other
  misc_feature (495)..(495): n is a, c, g, or t
  modified_base (500)..(515): a, c, t, g, unknown or other
  misc_feature (500)..(515): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgaggaggggttaatggcgccttaatgatcgacccggggcgcgggccggtgtacaagtgggaggggtagttacagtggacgtcgtgggggacaaagggaccacgagtcatcgtctccgcagctccaccaacgggcccagtcggtcccttccccgtggccnccctgcctccgaggcgcaccgtcgtcgggggacacgnggccggcccgtgggctcggcccgtgggtacaacgggtactacttccgtatcctcgtcgtctggaggccggcgtgggcaagggccgganagagnnnnnnnnnnnnnnnn

SEQ ID NO: 334510 - DNA, 544 bp, Homo sapiens
  misc_feature: GZ8MTXP01A5N9K.11.22.B11.1.454.CMB.2.raw
  modified_base (249)..(249): a, c, t, g, unknown or other
  misc_feature (249)..(249): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (519)..(519): a, c, t, g, unknown or other
  misc_feature (519)..(519): n is a, c, g, or t
  modified_base (524)..(544): a, c, t, g, unknown or other
  misc_feature (524)..(544): n is a, c, g, or t
tcagcgagagataccacgaccggtgctcgatttagacgacagctcaagggaaggggctagagtggattggggaaatcaatgatagtggaagcaccaactacaaccccgtccctcaagagccgagtcaccatatcagtagacacgtccaaagaaccagttctccctgaagttgacctccgtgaccgccgcggacacggctgtgtattatgtgcgaggaggggttatggctcttaatgatcggacccgggngcggcgtagtacaagtgggaggtagttacagtgggacgtcgtggggacaaagggaccacgagtcatccgtctccgcacgccttaccgaccgaacgggcccagttccggtcccttcccccgnggcccgccctcgccctcgacggaccncgaccgtcggtcggggaccacgccggccggcccgtggggctcggcgtacgggtacgaacggtacttaccgttcgtatccgtcgtacgtcgtggacggcgggtcgtacggaccgagggccgganagtannnnnnnnnnnnnnnnnnnnn

SEQ ID NO: 334511 - DNA, 452 bp, Homo sapiens
  misc_feature: GZ8MTXP02HMC7J.11.22.B11.1.454.CMB.2.raw
  modified_base (384)..(384): a, c, t, g, unknown or other
  misc_feature (384)..(384): n is a, c, g, or t
  modified_base (450)..(452): a, c, t, g, unknown or other
  misc_feature (450)..(452): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatgggagggagttacatggacgtctggggcaaaggggaccacagtcatcgtctccgcagcttccaccaagggcccatcggtcttccccctggcgccctgctccaggagcacctctggggcacngcggccctgggctgcctgtcaagctacttccgatctctcgctgagcgggctggcaaggcgcatagnnn

SEQ ID NO: 334512 - DNA, 455 bp, Homo sapiens
  misc_feature: GZ8MTXP02HZ4P1.11.22.B11.1.454.CMB.2.raw
  modified_base (380)..(380): a, c, t, g, unknown or other
  misc_feature (380)..(380): n is a, c, g, or t
  modified_base (450)..(455): a, c, t, g, unknown or other
  misc_feature (450)..(455): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatgggagggagttacatggacgtctggggcaaaggggaccacagtcatcgtctccgcagcttccaccaagggcccatcggtcttcccctggcgcctgctccagagcactctggggcacngcggcctggactgcctggtccaaggactacttccgtatctctcgctgagcgggctggcaaggcgcatagnnnnnn

SEQ ID NO: 334513 - DNA, 454 bp, Homo sapiens
  misc_feature: GZ8MTXP02G6SSZ.11.22.B11.1.454.CMB.2.raw
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
  modified_base (446)..(454): a, c, t, g, unknown or other
  misc_feature (446)..(454): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatggagggagttacatggacgtctggggcaaagggaccacagtcatcgtctccgcagcttccaccaaggcccatcggtctcccctggcnccctgctccnggagcaccnctggggcacngcgcctgggctgcctggtcaaggctacttccgtatctntcgctgagcgggctggcaaggcgcatagnnnnnnnnn

SEQ ID NO: 334514 - DNA, 513 bp, Homo sapiens
  misc_feature: GZ8MTXP02HNDWB.11.22.B11.1.454.CMB.2.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (497)..(513): a, c, t, g, unknown or other
  misc_feature (497)..(513): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgcttaangatggacccgggngcggccggtgtacaagtgggagggagttacagtggacgtcgtggggacaaaggggaccacgagtcatcgtctccgcacgcttccaccgaacggcccatccggtccttcccccgtggccgccctgcctccaggacgcacctcgtgggggccacgcggccggcccgtggggcctggaccgtgggtccaagggtacctaccgttcgtactcttctcgctgacggccgggcgtggcgaacgggcgactagtagnnnnnnnnnnnnnnnnn

SEQ ID NO: 334515 - DNA, 530 bp, Homo sapiens
  misc_feature: GZ8MTXP02G6FMW.11.22.B11.1.454.CMB.2.raw
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (507)..(530): a, c, t, g, unknown or other
  misc_feature (507)..(530): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagagggttaatggcgccttaatgatcggacccgggcgcggccggtgtacaagtgggaggagttacagtggacgtcgtggggacaaaggggaccacagtcatcgtctccgcagctccaccgaaggcccatccggtccttccccgngcccgccctgcctccgacggacnccacctcgtggggccacgcggccggcccgttgggcctcgcccgtgggtaccgaaacggaccttacccgtccgtactccgtccgtcgtcctggacggtcgggactcgggacgaagggccgacgatacgnnnnnnnnnnnnnnnnnnnnnnnn

SEQ ID NO: 334516 - DNA, 583 bp, Homo sapiens
  misc_feature: GZ8MTXP02IT8SK.11.22.B11.1.454.CMB.2.raw
  modified_base (331)..(331): a, c, t, g, unknown or other
  misc_feature (331)..(331): n is a, c, g, or t
  modified_base (562)..(562): a, c, t, g, unknown or other
  misc_feature (562)..(562): n is a, c, g, or t
  modified_base (564)..(583): a, c, t, g, unknown or other
  misc_feature (564)..(583): n is a, c, g, or t
tcagcgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttcctccctgaagttgaccctccgtgaccgccgcggacacggctgtgtattattgtgcgagaggggttaatggcgcttaatgatcggacccgggcgcggcggtgtacagtgggaggtagttacagtggacgtcgtggggaacaaacgggaccacgagtcacgtccgtcgtcccgancggtccttaccgaacccgaacggggtccctacgttcccggttccccttcccccgtcgggccctcccctcggcctcccggaggtacgaccgtaccgtccgggtcggggaccaacgcgggcccgggtcccggtggggcctcggtccgtgggtaccgaacgggtacctttcgtaccgttactccgtccgttacgcgtggtacggccgggtgtacgggacggaggtacgctaagngnnnnnnnnnnnnnnnnnnnn

SEQ ID NO: 334517 - DNA, 553 bp, Homo sapiens
  misc_feature: GZ8MTXP02GKSPB.11.22.B11.1.454.CMB.2.raw
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(525): a, c, t, g, unknown or other
  misc_feature (524)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(533): a, c, t, g, unknown or other
  misc_feature (531)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(545): a, c, t, g, unknown or other
  misc_feature (541)..(545): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
  modified_base (552)..(553): a, c, t, g, unknown or other
  misc_feature (552)..(553): n is a, c, g, or t
tcagcgagagataccacgaccggtgctcgatttagacgacagctcaagggaagggctagagtggattggggaaatcaatgatagtggaagcaccaactacaacccgtccctcaagagccgagtcaccatatcagtagacacgtccaagaaccagttctcctgaagttgacctcgngaccnccgcggacacggctgtgtattatgtgcgagaggggttatggcgccttaatgatgaccccggngcggccggtntacaagtgggagggtattacgagtggacgtcgtgggaccaaagggtaccacagtacatcgtccncgcacgtcctccgacgacggcctacgttccggtcctcccgnggccnccgtcgcctcgacggcacctcgtacggtcgggacacggccgggccgccgtcgggctccggtactggtaacgaaacgtccttaccgttactacgtctccgtcgtaccgtacgggcgtccggtacggtacgacgtaaggtcgacgagtacgatacgacntgncnngngncnnncnancngnnnnncnncncnn

SEQ ID NO: 334518 - DNA, 663 bp, Homo sapiens
  misc_feature: GZ8MTXP01A3AIR.9.37.D04.1.454.CMB.2.raw
  modified_base (219)..(219): a, c, t, g, unknown or other
  misc_feature (219)..(219): n is a, c, g, or t
  modified_base (384)..(384): a, c, t, g, unknown or other
  misc_feature (384)..(384): n is a, c, g, or t
  modified_base (483)..(483): a, c, t, g, unknown or other
  misc_feature (483)..(483): n is a, c, g, or t
tcagtgatacgtctcacgaccggtgctcgatttagtagcatactgttgggtttggggtctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtcgtggggganccctggtacaggccggggggtccctgacactctcctgtacagcctcgtggattcacctttaacacctatcgctattgagcgtgggtcccgcccgacgggcccccgagggggaacggggcgtggacgtggggtcgcgagccagttagtggcaagtggacgaaaacncataataacgcgagacctccggtaggaacggggtccggttacaccctatttacccagacgaactaatttacaaagtaaccacgtactacgtaattccgngtacagggtaattacgaaaccacgtaccgtagaacggacgacccggaaggtaaccgaccgggtaacccgtagtaactaccgttacgtacgttacgaacccgaaaagacgttacgaaagggtaaacgggtacgggtttaaccggggaaagtttaacaaagttaactttaaccgtttaaccg

SEQ ID NO: 334519 - DNA, 575 bp, Homo sapiens
  misc_feature: GZ8MTXP01B10KU.9.37.D04.1.454.CMB.2.raw
  modified_base (334)..(334): a, c, t, g, unknown or other
  misc_feature (334)..(334): n is a, c, g, or t
  modified_base (434)..(434): a, c, t, g, unknown or other
  misc_feature (434)..(434): n is a, c, g, or t
  modified_base (526)..(526): a, c, t, g, unknown or other
  misc_feature (526)..(526): n is a, c, g, or t
tcagtgatacgtctcacgaccggtgctcgatttagtagcatactgttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagacccggccctgagggatcccctgagcgattctctggctccaattcnggtgacacggcctaccccctgatcatcaagcgaaggggtcgagggtcgaggatggaggccgactattactgtcagggtggtggggataggtggtacgtgntcgtagttggggggttggttcggggcgggacgggaccgaggcgtggaccgtccgtaggtccacgcccgaaggcttcggcccccttgggtccncttcgttccgttccccaaccctcctcgacgtcgttactccgaacgtcgg

SEQ ID NO: 334520 - DNA, 803 bp, Homo sapiens
  misc_feature: GZ8MTXP01BFB24.9.37.D04.1.454.CMB.2.raw
  modified_base (234)..(234): a, c, t, g, unknown or other
  misc_feature (234)..(234): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (422)..(422): a, c, t, g, unknown or other
  misc_feature (422)..(422): n is a, c, g, or t
tcagtgatacgtctcacgaccggtgctcgatttagtagcatactgttgggtttggggtctgagagaggagcccagccctgggatttttcaggtgtttttcatttggtgatcaggactgaacagagagaactcaccatggagtctgggctgagcgtggtctttcttcgttgtggtacttaagtttttaaaaggtgtccagtgtgaggtgctatctagttggagtcgtgggggacncccgtggtacgagggcccgggggtcctgacactctctgtacncgcctntggtacttcctaacccgttttaacaccttagtcgtacctagtttagacgtccggttcgggacccgacccgacggggcccccggaagggggaacgggtcgtaggacggttcgggtcccgacgtacgaccgttagttacggnggacaaacggttcgggaaacaaaaacgtactaacgttaaacgttaccgcgaacgtacccgtacccgggtaagggtaaccggggtcccgttacaacccgttactttaccgaaggtaactaacgttaaattacgaaaacgtacgtaacgtcttagtaacttccgaggaccaaggggaactttaacggaaaccctacggaccgttaggaaccggtacgaaaccccgggaagaacccggttaacggccgttaaactaacgtacccgttaagttacccgggttacaaaccgtaaaaggacgttaccggttaaaggggtaacggggttaacgggttaaccggggtttaagttaacgttaaaactttaacgttttaacctttaaccgg

SEQ ID NO: 334521 - DNA, 540 bp, Homo sapiens
  misc_feature: GZ8MTXP02H1W0U.9.37.D04.1.454.CMB.2.raw
  modified_base (326)..(326): a, c, t, g, unknown or other
  misc_feature (326)..(326): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
tcagtgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccaccctcggtgtcagtggcccaggaaagacggcaccattacgtgtggggatacaacattggaagtaaagtgttcactgtaccagcagaagcaggccaggcccctgtgttggtcgtctatgatgatacagaccggccctcagggatcccctgagcgattctctggctcaatttcnggtgacacggccacccctgatcatcagcagggtcgaggtcgaggatggacgccgactatactgtcaggtgtgggataggtggtactgatcgtagttggggtgttcgggacgggaggggaccaagccgtagtacccgtctagggtcacggaccccaaggcctcgccccctcggcacctctcgttccccaaccctctacacgacgtacnctacgng

SEQ ID NO: 334522 - DNA, 535 bp, Homo sapiens
  misc_feature: GZ8MTXP02JSD4S.9.37.D04.1.454.CMB.2.raw
  modified_base (334)..(334): a, c, t, g, unknown or other
  misc_feature (334)..(334): n is a, c, g, or t
tcagtgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccaccctcggtgtcagtggccccaggaagacggccaccattacgtgtgggggatacaacattggaagtaaagtgttcactggtaccagcagaagccaggccaggcccctgtgttggtcgtctatgatgatacagaccggccctcagggatcccctgagcgattctctggctccaattctggtnacacggccaccccctgatcatcagcaggggtcgaggtcgaggatggaggccgactattactgtcagggtgtgggataggtggtactgatcgagttggggtgttcgggcggaggggaccaaggctgaccgtctaggtcagcccaaggctcgccccctggtcactctcgttccccaacccgtcctcacgacgtactcactcgg

SEQ ID NO: 334523 - DNA, 621 bp, Homo sapiens
  misc_feature: GZ8MTXP02FL87N.9.37.D04.1.454.CMB.2.raw
tcagtgatacgtctcacgaccggtgctcgatttagtagcatactgttgggtttggggtctgagagaggagcccagccctgggattttcaggtgttttcatttggtgatcaggactgaacagagagaactcaccatggagtctgggctgagcgtggcttcttcgttgtggctaattttaaaaggtgtccagtgtgaggtgcatctattggagtcgtgggggagccctggtacaggccgggggggtccctgacactctcctgtacagcctctggattcacctttaacacctatgcattgagctggggtcccgccgacgggcccccgaggggaacggggcgtgggaccgtggggtaccgcaggccctagttaggtggcaagtcggacgaaaacacatattacgcagactccgtagacggggccgttcaacctatttcccaagtacgaactaatttacaaagaacacgctgtatctgacagatgaacacgaccagacgaggacccggaggaccgaccgggaccgtataactcacgttagacgacccgaaaacggtaacgacggaaggtaaggggtacggggttacggggtaaacgttaaacgtaaacgtttaacttaacttaacg

SEQ ID NO: 334524 - DNA, 614 bp, Homo sapiens
  misc_feature: GZ8MTXP02GM200.9.37.D04.1.454.CMB.2.raw
tcagtgatacgtctcacgaccggtgctcgatttagtagcatactgttgggtttggggtctgagagaggagcccagccctgggattttcaggtgttttcatttggtgatcaggactgaacagagagaactcaccatggagtctgggctgagctggcttcttcttgtggctaattttaaaaggtgtccagtgtgaggtgcatctattggagtcgtgggggagcccgtggtacgaggccgggggggtccctgacactctcctgtacagcctctggattcacctttaacacctatgcattgagctgggtccgccaggccccgaggggaagggcctggacgtgggtcgcagccattagtggacaagtcgggacaaaacacgatacttacgcagactccgtagaacggggccgtttacaccctatttcccgaagaagaactaatttacgaaaagaccacgtctagtactctacggcaagatcgaaacacgccgtagacgacgaccggaaggaccgaacggtaccgtaatactacaccgttagacgaacctaaagacgtaccgaagggtaacggtaacggggttacggggtaattaaaccgtaaatactttaacgttaacc

SEQ ID NO: 334525 - DNA, 601 bp, Homo sapiens
  misc_feature: GZ8MTXP02IIS56.9.37.D04.1.454.CMB.2.raw
tcagtgatacgtctcacgaccggtgctcgatttagtagcatactgttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtggtgggggatacaacattggaagtaaagtgttcactggtaccagcagaagccaggccaggcccctgtgttggtcgtctatgatgatacagacccggcccctcgagggactccccgtgagcgattctctggctccaattcgtggtgaccacggcccaccccgtgactcatcgagcagggggtcaggtcgaggatggacggccgactatactgtcgaggtgtggagtaggtggtactgatcgtagtttgggtggtttcgggcgggtagggaccgaagcgtagtaccgtacgtaggtccacgcccgaacggtccgtccggcccccttcgggtaccctaccgttcccttccgtttacccccaacccttccccgtaccgtacgtaaccgtactaccgtaccgtacggg

SEQ ID NO: 334526 - DNA, 588 bp, Homo sapiens
  misc_feature: GZ8MTXP02IQLI0.9.37.D04.1.454.CMB.2.raw
tcagtgatacgtctcacgaccggtgctcgatttagtagcatactgttgggtttggggtctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtctgggggagccctggtacagccggggggtccctgacactctctgtacagcctctggattcaccttaacacctatgcattgagctgggtccgccagggccccaggggaaggggctggacgtggggtcgcgagccagttagtggacaagtgggaccgaaaaacacaataacttacgcaagactccggtgaaacggggccgtacaaccatttccagtacgactaatttacaaagaacacgctagtactactgacagatagaacaggacctgagacgcgaaggactacgggcctaatactacacgtgtacgaaccaaaagactacgaaggaaaggtacgggtaacgggggattaaacgtaaaattaactttaactttaaaccg

SEQ ID NO: 334527 - DNA, 518 bp, Homo sapiens
  misc_feature: GZ8MTXP01BADW8.25.38.D05.1.454.CMB.2.raw
  modified_base (420)..(420): a, c, t, g, unknown or other
  misc_feature (420)..(420): n is a, c, g, or t
  modified_base (502)..(502): a, c, t, g, unknown or other
  misc_feature (502)..(502): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaaacaataaggacttctagcttggtatcagcagaaaccaggcagcctcaagctgctcatgtacgtggcgtcgtacccgggaactccccggtcgtcctgacccgtattcgaggtcgggcggcgggtctgggacagtctttcactctacacatcagcagcctgcaggctagaagngtgtggctagtttatacgtgtacagctaattattactactaactccggttctacgttcgggcggtcggacgaggttcgaagntcgagagactgttggc

SEQ ID NO: 334528 - DNA, 505 bp, Homo sapiens
  misc_feature: GZ8MTXP01DUMBZ.25.38.D05.1.454.CMB.2.raw
  modified_base (282)..(282): a, c, t, g, unknown or other
  misc_feature (282)..(282): n is a, c, g, or t
  modified_base (486)..(486): a, c, t, g, unknown or other
  misc_feature (486)..(486): n is a, c, g, or t
  modified_base (501)..(501): a, c, t, g, unknown or other
  misc_feature (501)..(501): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttctagcttggtatcagcagaaaccnggcagcctcctaagctgctcatgtactggcgtctacccgggaatccccggtgtcctgacccgattccagtggcgggcgggtctggggacaggatttcactctcaccatcagcagcctgcaggctagaagatgtggcagtttatactgtcaagctaatattatctaactcggttcacgtttcggcggtcgggaccaggttggaanatcgaagagaactgnggtc

SEQ ID NO: 334529 - DNA, 627 bp, Homo sapiens
  misc_feature: GZ8MTXP01AYSAZ.25.38.D05.1.454.CMB.2.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggaatccctgagactctcctgtgcaacatctggattcgccttcagtaactttggcatccactcgggtccnccaggctccaggcaagggctagagtgggttntactttgnggnagtgatggacgngtagtaagtaaacgtactagtagacgacgacgtaccgtacgacggaccgtccgttcctacctactcctaccgacgaacgaacgaaccgaaccgaaacgggtaacggtaaccggttaccgtttacgtaacgtaaacgtaacgaaacgtaccgtacgtaaccggaacccggaaccggaaccgaaccgtacgttagttacgttaacgttacgttacgttacgcgacggaacgacgtaacggtaggaggttaggtcggttcggtaacgg

SEQ ID NO: 334530 - DNA, 528 bp, Homo sapiens
  misc_feature: GZ8MTXP01AX899.25.38.D05.1.454.CMB.2.raw
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (472)..(472): a, c, t, g, unknown or other
  misc_feature (472)..(472): n is a, c, g, or t
  modified_base (506)..(506): a, c, t, g, unknown or other
  misc_feature (506)..(506): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctacaacaataaggacttctagcttggtatcagcaagaaaccaggcagcctcaagctgctcatgtacgtggctcgtacccgggaatccccggtcgtcctgacccgtattcgagtggcgggcgggtctgggacagtactttcactctcaccatccagcagcctgcaggctagaagngtgnggactaggtttatactgtaccaagctaaattattactactaactcccggttntacgtttcgggcgtacgggaccgaagggttgaantcgaagaagttacttggaaggc

SEQ ID NO: 334531 - DNA, 498 bp, Homo sapiens
  misc_feature: GZ8MTXP01C0YDE.25.38.D05.1.454.CMB.2.raw
  modified_base (495)..(495): a, c, t, g, unknown or other
  misc_feature (495)..(495): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttctagcttggtatcagcagaaaccaggcagcctctaagctgctcatgtactgggcgtctaccgggatccccggtgtcctgaccgattcagtggcggcgggtctgggacagtattcactctcacatcagcagcctgcaggctagaagagtgtggctagtttatactgtcagctaatattatactaactccggttctacgttcggacggtcggacgagggttgaagatcgagacgactgnggc

SEQ ID NO: 334532 - DNA, 554 bp, Homo sapiens
  misc_feature: GZ8MTXP01CJKNM.25.38.D05.1.454.CMB.2.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggatccctgagactctcctgtgcaacatcnggattcgccttnagttaactttggcatccacgtcgggtccnccgaggcctccgaggcaagggactaggagtgggtntacgtttttagtgggcagtgatgggctaagtgaattaaagcctatgcagactcgtcgacgggccgtcttctcactcctcagacaacacgaccaaggaacgtaccggttcctttacgaactaaacgtagaaaacgtcctagaacgacccgaggacaacggcttatgttattacgtgttacgcgagaacgcgaagtgagaggtggcgtaagg

SEQ ID NO: 334533 - DNA, 647 bp, Homo sapiens
  misc_feature: GZ8MTXP01A6CFZ.25.38.D05.1.454.CMB.2.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtggttttccgcgttaggctctttaagaggtgtccagtgtcaggtgcagntggtggagtcgtgggggagcgtggtccagcctgggaagtccctgagactctcctgtgcaactntngtntcnctnagtactgcntccngtcggccncgagcncgagacgaaggatagngtggtnttacgtttagtggatagtgagtcgagtgtagtaagtaaacgtacgtagtacgacgacgtaccgtaccgtacggtacggtccgtccttcctacctactacctaccgaacgaacgaaccgaaccgaaccgaaacggggtaaacggtaaccggttaccgttacgtaacgtaaacgtaaacgaaacgtaaccgtacggtaaccggaacccggaaccggaacggtaaccggtaacgttacgttacgttacgttaacgtacggttacggacggacggtaacggtacggtaacggtaggtaggttacgggtcggttaacggtaacgg

SEQ ID NO: 334534 - DNA, 559 bp, Homo sapiens
  misc_feature: GZ8MTXP01EJHXX.25.38.D05.1.454.CMB.2.raw
  modified_base (268)..(268): a, c, t, g, unknown or other
  misc_feature (268)..(268): n is a, c, g, or t
  modified_base (347)..(347): a, c, t, g, unknown or other
  misc_feature (347)..(347): n is a, c, g, or t
  modified_base (528)..(528): a, c, t, g, unknown or other
  misc_feature (528)..(528): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaactccctgagactctcctgtgcaacatcnggattcgccttcagttaactttggctatccacgtcgggtcccgccaggcctccgaggccaaaggggctaggagtgggtntacttttagtggggcatgatggcaagtgaataaagcctaatgcagactcgtcgaacggccgcttctcatcctcagacgaacaacgaccaaagggaacgtacggttacctttagaccaaatagaaagcctagacgaccgaggtacaaggtcttagtagttattacgtagttgcgaaggaacnccgtaaggttggaggaggtcggcgtaagggg

SEQ ID NO: 334535 - DNA, 521 bp, Homo sapiens
  misc_feature: GZ8MTXP01D2CFL.25.38.D05.1.454.CMB.2.raw
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
  modified_base (394)..(394): a, c, t, g, unknown or other
  misc_feature (394)..(394): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggagcgtggtccagcctgggaatccctgagactctcctgtgcaacatcnggattcgccttcagtaactttggcatccactgggtccnccaggctccaggcaaggggctagagtgggtgactttttagtgggcatgatgggcaagtgaataaagcctatgcagactcgtcaagggccncttctccatctccagacgacaacgccaaagggaacgtacgggttcctttaggacaaatgaaaagcctgacgacccgaggacaacggnttatgttatactgttcgngagncaagtgagagtgcgaagg

SEQ ID NO: 334536 - DNA, 500 bp, Homo sapiens
  misc_feature: GZ8MTXP01EWKOW.25.38.D05.1.454.CMB.2.raw
  modified_base (334)..(334): a, c, t, g, unknown or other
  misc_feature (334)..(334): n is a, c, g, or t
  modified_base (403)..(405): a, c, t, g, unknown or other
  misc_feature (403)..(405): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (484)..(484): a, c, t, g, unknown or other
  misc_feature (484)..(484): n is a, c, g, or t
  modified_base (497)..(497): a, c, t, g, unknown or other
  misc_feature (497)..(497): n is a, c, g, or t
tcagactgtacagtcacgaccggtgctcgatttagtatctgatagttgggtttgggggagctacaacaggcaggcaggggcagcaagatggtgttgcagaccccaggtcctcatttctctgttgctctggatctctggtgcctatggggacatcgtgatgacccagtctccagactccctggctgtgtctctgggcgagagggccaccatcaactgcaagtccagccagagtatttttacagctcaaacaataaggacttctagcttggtatcagcagaaaccagggcagcctctaagctgctcatgtactggctcgtacccggatccccggtntcctgaccgattccgagtcgggcggcgggtctggggacaggactttcacttcacaccgatcagcagccnnngnagagagtgtgtntagttatntntnanatatatactactaactcgttcgtcgttcggtcggcggacgaggaggaaganaacgagagagtgngtg

SEQ ID NO: 334537 - DNA, 528 bp, Homo sapiens
  misc_feature: GZ8MTXP01AR4T3.25.38.D05.1.454.CMB.2.raw
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (463)..(463): a, c, t, g, unknown or other
  misc_feature (463)..(463): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaatccctgagactctcctgtgcaacntcnggattcgccttcagtacttggcatccatggtccncaggctccaggcaaggggctagagtgggtntactttttagtggggcagtggaattgggctaaggtgaaattaaacggcctaagtcggacagactccgtcgaagggccgcttctccatctccagagacaacgcaaggaagacggtcctttagacaaatgaaancctagacgacccgaggacaacggcttatgttatactgttgcgagaagcaagtgagagtggcaagg

SEQ ID NO: 334538 - DNA, 585 bp, Homo sapiens
  misc_feature: GZ8MTXP01C07PS.25.38.D05.1.454.CMB.2.raw
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagtatttttacagctccaacaataaggacttntancttggtatcagcagaaaccaggcagcctctaagctgctcatgacgtggcgtccgtaccggaactcccccggtcgtccctgacccgtattacgaggttgggccgggtcggggtcgtggggacctaggtactttccgacttctaccaccatccagcacgcctgccaggctagaacgagtgtcggtcttaagtttattacgtgttaccagtactaaattacttaactacgttaaccgtacggttcctaacggtttcgggacgggtcccgggaaccgttaagggttggaagacgtcgaacggaccgttaacgtgggttcgtaacg

SEQ ID NO: 334539 - DNA, 554 bp, Homo sapiens
  misc_feature: GZ8MTXP01DR2M1.25.38.D05.1.454.CMB.2.raw
  modified_base (438)..(438): a, c, t, g, unknown or other
  misc_feature (438)..(438): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagtatttttacagctaccaacaataaggacttctagcttggtatcagcaagaaaccaggcagcctctaagctgctcatgtacgtggctcgaccggatccccggctcctgaccgattcgaggtcggcgggccgggtctgggacagtatttcactctcacatcagcagcctgcaggctagaagagtgtggtactagtttatactgtacagntaaattcttaagtaccttaacgtcccgggttactacggtttccggacggggtccgggaaccgaagggttcggaagtaattccgaaagggaccgttaaacgtttcggggttcggtcg

SEQ ID NO: 334540 - DNA, 552 bp, Homo sapiens
  misc_feature: GZ8MTXP01D4R97.25.38.D05.1.454.CMB.2.raw
  modified_base (523)..(523): a, c, t, g, unknown or other
  misc_feature (523)..(523): n is a, c, g, or t
  modified_base (548)..(548): a, c, t, g, unknown or other
  misc_feature (548)..(548): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgcaagtccagccagtagttatttttacagctacaacaataagacttctagcttggtatcagacaagaaaccagggcacgcctacctaagctgctcatgtacgtgggcgtccgtacccgggaacttccccggtcgtcctcgaccgtattcgaggtgggcgggcggggtcgtggggactaggtactttcactctcaccatcagacagccctgcgacggctagaagtagtggtggtacttaagtttatcgtgtacagtactaattattatacctaacttccggttactcgttcgggcggtacgggaaccgngggttacgaagatcgagacgagtgngtcg

SEQ ID NO: 334541 - DNA, 511 bp, Homo sapiens
  misc_feature: GZ8MTXP01AK816.25.38.D05.1.454.CMB.2.raw
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (442)..(442): a, c, t, g, unknown or other
  misc_feature (442)..(442): n is a, c, g, or t
  modified_base (508)..(508): a, c, t, g, unknown or other
  misc_feature (508)..(508): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttattttttacagctaccaaacaataaggacttctagcttggtatcagcagaaaccagggcagcctcctaagctgctcatgtactggcgtctacccgggatccccggtgtcctgacccgattcagtggcggcgggtactgggacagactttcacttctcaccancngcncgcncgcgacgcgagagaggtgtgtgtagttattagtgtacanataatatactactaactcgttcgtcgttcggtcggcggacgaggagaagagaacgagacgacgtgngtg

SEQ ID NO: 334542 - DNA, 724 bp, Homo sapiens
  misc_feature: GZ8MTXP01BKBTY.25.38.D05.1.454.CMB.2.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggatccctgagctctcctgtgcaaactntcgngtacttccgtccttataacgttacttggacctactcccgacggtcgggtccccgccgacggtccctaccggaagggtaccgaaagggggtacgtagggtagggttggggttacgtttaacgtttttaggtggggactaggttaggtagtacgggactaagggtagtaaacgtaaacgtcctaagtcggacgaacgtacccgtaccggtacggaaccgggtcctccttccctacctactcctaccgaacgaacgaaccgaaaccgtaaccgaaacggggtaaccggttaccggtttaccctttaacggaaactaaaacgtaacggaaaaccggtaccgaacggaacccggtaacccggaacggaccgaacggtcttaagttacgttacgttacgtaggttacggacggaaggaaccgacgtaaggtaggacggttagggtccggttcggtaacgg

SEQ ID NO: 334543 - DNA, 555 bp, Homo sapiens
  misc_feature: GZ8MTXP01A1XVQ.25.38.D05.1.454.CMB.2.raw
  modified_base (183)..(183): a, c, t, g, unknown or other
  misc_feature (183)..(183): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (500)..(500): a, c, t, g, unknown or other
  misc_feature (500)..(500): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagnggtgtccagtgtcaggtgcagctggtgagtcgtggggagcgtgtcagccgtgggatcctgagactctctgcacantcgngtctcgcttanacgttactgactactccgacgtcggccncgagcctcgaggacgaagggtactaggtaggtggtacgttacgttttaggtcggatagtgagtgacgtaagtagaaataacgctagcgacacgtactaccgtacgacggcctcttcactactcacgagacgacaacgacgaagggtacgtacgttcttagaactaagacgaacgtacgacgacgaccgagacgaacgtnttatgttacgtacgtagttgcgagaacgtacgaagtggagttaggtcggcggtgg

SEQ ID NO: 334544 - DNA, 565 bp, Homo sapiens
  misc_feature: GZ8MTXP01C89UI.25.38.D05.1.454.CMB.2.raw
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (545)..(545): a, c, t, g, unknown or other
  misc_feature (545)..(545): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaagtccctgagactctcctgtgcaacntcnggattcgccttnagttaaactttggctatcccacgttcgggtcccnccaggctccgaggccaagggctaggagtgggtntacttttagtgggcatgatgggcngtgaataaagctatgcagactccganaacgggccgtcttctcatcctacagacgacaacgaccaagggaacgtaccgggttacctttaggaactaaagtaggaaaacgaccgtaggaacgacccggaacggaaccgaacgggtcttattgttaattacgtgttgcgagcgacngtagagaggtggcgtaaggg

SEQ ID NO: 334545 - DNA, 517 bp, Homo sapiens
  misc_feature: GZ8MTXP01A38V5.25.38.D05.1.454.CMB.2.raw
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (391)..(391): a, c, t, g, unknown or other
  misc_feature (391)..(391): n is a, c, g, or t
  modified_base (495)..(495): a, c, t, g, unknown or other
  misc_feature (495)..(495): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagtatttttacagctcaacaataaggacttctagcttggtatcagcagaaaccnggcagcctcaagctgctnatgtactgggctcgtacccgggatccccggtgtcctgacccgattccaggtggcgggtcgggtcgtgggacagtactttcgactctcaccntcagcagcctgcaggctgaagagtgtgctagtttatactgtcagactaatattactactaacgtccgttctacgtttcgggcggtcggaccgaggttcggaagntccgagacgaacgtgttcgggc

SEQ ID NO: 334546 - DNA, 535 bp, Homo sapiens
  misc_feature: GZ8MTXP01AWUME.25.38.D05.1.454.CMB.2.raw
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaatccctgagactctcctgtgcaacntcnggattcgccttnagttaacttggcatccacgtggtcccncaggctcgaggcaaagggctagagtgggtntacttttagtgggctagtgatgggcaagtgaattaaagcctatggcagacctccgtacagggccncttcncatcncagacgacaacgccaaaggacgtacggttcctttagacaaagtgaaaacgcctgacgacccgaggccaacggcttagtcgttatacgtgttagcgagaagccaagtgaggagtcggctaaggg

SEQ ID NO: 334547 - DNA, 621 bp, Homo sapiens
  misc_feature: GZ8MTXP01DF17G.25.38.D05.1.454.CMB.2.raw
  modified_base (249)..(249): a, c, t, g, unknown or other
  misc_feature (249)..(249): n is a, c, g, or t
  modified_base (477)..(477): a, c, t, g, unknown or other
  misc_feature (477)..(477): n is a, c, g, or t
  modified_base (578)..(578): a, c, t, g, unknown or other
  misc_feature (578)..(578): n is a, c, g, or t
  modified_base (618)..(618): a, c, t, g, unknown or other
  misc_feature (618)..(618): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggttgtccagtgtcgaggtgcagctggtggagtcgtgggggagcgtggtcagccgtggactcctganactctctgtgcaacatcgtggattcgccttagagtttaactttggcactcccacgttcgggtcccgccgacggtcctccgaaggcccgaaagggggtacttaggaggttgggggtactttaacgttttttacggtcggggacagttggacgtgggaccaaggttgaaataaaaccggcctttaagcgacgacgtacctccgtacgacgggccgtcttctacccattcncgagacgaaccgaacgacccaaaggggacgtaccggttacctttagaacgtaaacgtaggaaacgtccgtagaaccgaccggacgacgaaccggtattagngtttatacgtgttgcgagaagccgaaggtgaggcgtcggngtg

SEQ ID NO: 334548 - DNA, 638 bp, Homo sapiens
  misc_feature: GZ8MTXP01AVIIQ.25.38.D05.1.454.CMB.2.raw
  modified_base (329)..(329): a, c, t, g, unknown or other
  misc_feature (329)..(329): n is a, c, g, or t
  modified_base (427)..(427): a, c, t, g, unknown or other
  misc_feature (427)..(427): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatcgacccagtctccagactccctggctgtgtctcgtgggcgagacgggccaccatcaactgcaagtccagccagtagttatttttacacgctaccaaacaataaggtacttactagtcgttggtatcagacaaggaaaccaggcacgtcctacctaagctgctcatgtacgnggacgtcgtaacccgggactccccggtctccgtagaccgtattacgcggtcgggcgggtcgggtctacggggacagtactttcaccttcaccactacncaacgtcacgtcctgacgaggtactagaaagtgggttggtacgggtactttaaggtttaactccggttagtacgtaaactcttaaaaattctttaaactaaacccgttccgttccgggttaacgttaccggtttcgggacccggggacgggttaacccgaaggggttcgaagacgttaacggaaaggtaaccgttacgtgggttggtcccg

SEQ ID NO: 334549 - DNA, 645 bp, Homo sapiens
  misc_feature: GZ8MTXP01DXI0D.25.38.D05.1.454.CMB.2.raw
  modified_base (341)..(341): a, c, t, g, unknown or other
  misc_feature (341)..(341): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaatccctgagactctcctgtgcaacatctggattcgccttcagttaactttggcatccacgtcggtccgccaggctccgaggcaagggctagagttggggtntacttttagtgggcagtgatgggcaagtgaataaaacgccttaagtcgcgacgtaccgtccgtacgaacggggtcccgtcctttctaccctaacttcctacccgaaggaaccgaacaaaccgacccgaaaacggggtaaacgtaaccggggtttacccttttacggaacctaaaagttaacgaaaacggtacccgtaggaaccggaacccggacggaacgaacgggtacttaagttcggttattaaccgttggttaggccggaaggaacggaccgtaaggtggaggaggttcgggaacgtgggg

SEQ ID NO: 334550 - DNA, 559 bp, Homo sapiens
  misc_feature: GZ8MTXP01D5Q6A.25.38.D05.1.454.CMB.2.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggtttttcctcgttgcttcttttaagaggtgtccagtgtcaggtgcagctggtggagtcgtgggggagcgtggtccagccgtgggaactccctgagactctctgtgacaacntctggattcgccttnagttaactttggcatccacgtcgggtcccnccgagctccgaggacaagggctagagtggtntacttttagtgggcatgatgggcngtnaataaagcctaatcgcagactccgtacgaacggggcctcttctacctattccaccgagacgaacaacgacctaaagggaacgtacgttacctttagaacaaagtagaaaacgcctaggacgaccgacgtacaacggcttagtgttatacgtgttgcgagaacgtcaagtgacgttagtcgcgtaagg

SEQ ID NO: 334551 - DNA, 645 bp, Homo sapiens
  misc_feature: GZ8MTXP01D2524.25.38.D05.1.454.CMB.2.raw
tcagactgtacagtcacgaccggtgctcgatttagtatctgatagttgggtttgggggagctacaacaggcaggcaggggcagcaagatggtgttgcagaccccaggtcctcatttctctgttgctctggatctctggtgcctatggggacatcgtgatgacccagtctccagactccctggctgtgtctcgtgggcgagagggccaccatcaactgcaagtccagccagtagttatttttacagctaccaacaataaggacttctagcttaggtatacagacaagaaaccagggacacgccctactaagctgctacatgtaacgtgggtctaccgtacccgggaacttccccggtcgtcctagacccgtacgttccgaggtcgggcgggtcggggtcgtacggggacctaggtacttttaccacttcctaccaacccataccaagccgaacgtcccgtagacgaggctaagtaagtacggtggtacgtacttaagtttacttacgtgtacgtaacgtaactaattaacttacttaccgttaaccgttccggttacgttaccggttccgggaccgggtaaccgggttaacgttaacgggttaggtaacgtacgtaacggaacggtaacgttacgtcggttcgtcg

SEQ ID NO: 334552 - DNA, 537 bp, Homo sapiens
  misc_feature: GZ8MTXP01EVASH.25.38.D05.1.454.CMB.2.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (516)..(516): a, c, t, g, unknown or other
  misc_feature (516)..(516): n is a, c, g, or t
  modified_base (537)..(537): a, c, t, g, unknown or other
  misc_feature (537)..(537): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtggcgagagggccaccatcaactgacaagtccagccagtagttatttttacagctaccaacaataagtacttctagcttggtatcagacaagaaaccgagggcacggcctaccaagctgctcatgtacgtggccgtacgtacccggatccccggtcgtcctgtaccgtattccgagggtcgggcggtcggggtcgtgggaactagtactttccactctcaccatcaagcatccgngcgagntagagtggtgtagtacttagttatctgtacatactaatattactactcgtcgttcgtcggttcggcggtacggacgaggagaanagtaacgagtagacgtgttgn

SEQ ID NO: 334553 - DNA, 643 bp, Homo sapiens
  misc_feature: GZ8MTXP01DZFUY.25.38.D05.1.454.CMB.2.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggaagtccctgagactctccngtgcaacatcgnggattccgtccttcaagttaactttggctatcccacgtcgggtcccnccaggctccgaggcaaagggctaggnggtgggtntacttttagngggactagtgagttgggactaaggtagaaacttaaaacgggcccttaagtcgacgtaaacgtacccgttaccggtacgaaacggggccctccttcctacctactcctaccgacgaacgaaccaacgaccgaaacgggaacgtacggtttacctttagaactaaagtaacgaaaacgtaccgtaggaaccgaacccggaaggaaccgtaacggtcttaagttagttaacgtttaccgtggttacgcggagaacgacgaaggtagaggacggtcgcgtaaggg

SEQ ID NO: 334554 - DNA, 621 bp, Homo sapiens
  misc_feature: GZ8MTXP01EPRRK.25.38.D05.1.454.CMB.2.raw
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggaactccctgacgctctctgtgcaacatcnggattcgccttnagttaactttggcatccacgtcggtcccgccaggcctaccgaggaccgaaagggactaggaggttggggtatacgtttttagtggggactagtgagtgggactaaggtagaaataaacgccttaagtcggactagtaccgtccgtacgaacggggtcctccttcctacctacttccaccaagacgaacaaacgaccaaagggtaacgtaccggtttacctttagaactaaagtacgaaaacgtcgtacgacgacccgatggaaccgtacggttactagttagttaacttacgttaggttcgacggaagacgaaccgaggaggaggtaaggttggaacgg

SEQ ID NO: 334555 - DNA, 608 bp, Homo sapiens
  misc_feature: GZ8MTXP01C9MOT.25.38.D05.1.454.CMB.2.raw
  modified_base (344)..(344): a, c, t, g, unknown or other
  misc_feature (344)..(344): n is a, c, g, or t
  modified_base (585)..(585): a, c, t, g, unknown or other
  misc_feature (585)..(585): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggaagtccctgagactctcctgtgcaacatctggattccgccttcagttaactttggcatccacgtggtccgccaggctccgaggcaaagggctaggagttgggtntacttttagtggggcagtgagtgggctaaggtagaaacgtttaaaaggccctaatcggacaacgtaccgttcccgtaccgaaacggggtcccgtccttaccctccctaacttcctacccgaagaacgaaccaaaccgacccgaaaggtaaacggtaccggttaccgttttagacaaagttaacgaaacgtcctagacgacccggaggacgaacggcttagtgttactacgtgttagcgagngcaagtgagagtcggcgtaaggg

SEQ ID NO: 334556 - DNA, 542 bp, Homo sapiens
  misc_feature: GZ8MTXP01D9WK3.25.38.D05.1.454.CMB.2.raw
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
  modified_base (423)..(423): a, c, t, g, unknown or other
  misc_feature (423)..(423): n is a, c, g, or t
  modified_base (518)..(518): a, c, t, g, unknown or other
  misc_feature (518)..(518): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaagtccctgagactctcctgtgcaacatcnggattcgccttcagttaactttggcatccacgtgggtcccgccaggcctccgaggcaaggggactaggagtggggtntactttttagtgggcagtgatgggcaaggtgaataaagcctaatgcagactccgtcgaacgggccgcttctccatcnccagacgacaacgaccaagggaacgtacggttcctttagacaaatgaaaagcctgacgacccgaggacaacggcttatgttatactgttgcgagngcaagtggagaggtggcgtaaggg

SEQ ID NO: 334557 - DNA, 597 bp, Homo sapiens
  misc_feature: GZ8MTXP01B89QK.25.38.D05.1.454.CMB.2.raw
  modified_base (436)..(436): a, c, t, g, unknown or other
  misc_feature (436)..(436): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgcaagtccagccaagtagttatttttacagctaccaaactaagtaaggtacttctagtcttggtatcagacaagaaaccagggcagcctctaagctagctcatgtacgtggcgtcgtacccggaacttccccggtcgtcctgacccgtatcgacggtgggccgggtcgggtcgtggggactagtactttcgaacttcaccaccatcgagaccgacgtcccngacgagtagagaagtggtggtacgtacgttagttatcgtagtacgtaatactaattacttactaccgttaaccgtcgttacgtacggttccgggacgggtacggttaaacggagggttacgaagtacgtaacgaaggacgttacgtcggttaacgtaaccc

SEQ ID NO: 334558 - DNA, 502 bp, Homo sapiens
  misc_feature: GZ8MTXP01BC8R1.25.38.D05.1.454.CMB.2.raw
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (382)..(382): a, c, t, g, unknown or other
  misc_feature (382)..(382): n is a, c, g, or t
  modified_base (402)..(404): a, c, t, g, unknown or other
  misc_feature (402)..(404): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (474)..(474): a, c, t, g, unknown or other
  misc_feature (474)..(474): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctggcgagagggccaccatcaactgcaagtccagccagagttatttttacagctacaacaataaggacttctagcttggtatcagcagaaaccnggcagcctcctaagctagctcatgtacnggctctaccggatccccggtntcctgacctnttcaggtcggcgggcgggtcctggggacagtatttcactntacaccatccagccagtccnnngnagagagtagtgtgtattatntntananatatatactactaactcgttcgtcgttcggtcggcggacgnggagaagagaacgagagacgtgttgtcg

SEQ ID NO: 334559 - DNA, 626 bp, Homo sapiens
  misc_feature: GZ8MTXP01CU05U.25.38.D05.1.454.CMB.2.raw
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtggggcgagacgggccaccatcaaactgacaagtccagccagtagttatttttacagactaccaaacaaataaggtacttctagcttaggtatacagacaaggaaaccagggacagccctacaacgctagctcaatggtacgtgggaccgtacgtacccggggtaacttcccccgggtcgttacccgngaccgtatttaccgagggttcgggcggggtcggggtcgtacgggggaactaggtactttaccacttcacaacctatccgaagcacggtccngacgagcgtagaagtgttggtaggtacttaagtttactacgtgtacaagtactaaattattactacctaaccgttccggttacgtacggttccgggacgggtacggttaaacgagggttagaagtacgtaacgaacggacgttacggtggttcgtc

SEQ ID NO: 334560 - DNA, 588 bp, Homo sapiens
  misc_feature: GZ8MTXP01BXW16.25.38.D05.1.454.CMB.2.raw
  modified_base (500)..(500): a, c, t, g, unknown or other
  misc_feature (500)..(500): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgacccagtctccagactccctggctgtgtctcgtgggcgaggacgggccaccatcaactgacaagtccagccaagtagttatttttacagtactacaaacaaataaggtacttactagtcttggtatcagacaagaaaccgaggcacgccctactaagctgctcatgtacgtgggccgtacgtacccgggatcccccggtcgtcctagaccctattaccgaggtcggggcgggccggggtcgtacggggacctaggtactttccaccttctaccacctataccgaagtcccagccctgaccgaggctagaagtgtggtggtactaggtttatcgtgtacanataaattattactacgtaactccgttgtacgttcggggacggtcgggaaccgttagggttgaaggtatcgagacgttaagtgttcggc

SEQ ID NO: 334561 - DNA, 547 bp, Homo sapiens
  misc_feature: GZ8MTXP01EHRKM.25.38.D05.1.454.CMB.2.raw
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggatccctgagactctctgtgcaacatcnggattcgccttcagtaactttggcatcccacgtgggtccnccgaggctccgaggcaaagggctaggngtggggtntacttttagtgggcatgatggcaagtgaaactaaagcctagtgacagacctcgtacgaagggccgcttctaccactctaccagacgaacaacgaccaaagggaagtaccggttacctttagaacaaagtagaaaacgaccgtagaacgaccgaggaacaacggcttatgttatacgtgttgcgangcaagtgagngtgngtaacgg

SEQ ID NO: 334562 - DNA, 571 bp, Homo sapiens
  misc_feature: GZ8MTXP01AIAWY.25.38.D05.1.454.CMB.2.raw
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtggcgagagggccaccatcaactgcaagtccagccagagtatttttacagctacaacaataaggacttctagcttggtatcagcaagaaaccagggcagccctactaaagctgctcatgtacgtggccgtctacccgggatcccccggtcgtcctgacccgtagttaccgaggtcgggccgggtcgggtcgtggggacctaggtactttcactctcaccatcagcagccctagccagctagaangtgtaggctaagtttntactgtcaactntaaattacttaactacgtaactcccggttactaccgtttggacccggggtcgggttaacccttaggggttcgaagtactaacgaaggtaacgttacgtcggttaagtc

SEQ ID NO: 334563 - DNA, 537 bp, Homo sapiens
  misc_feature: GZ8MTXP01E2NBE.25.38.D05.1.454.CMB.2.raw
  modified_base (427)..(427): a, c, t, g, unknown or other
  misc_feature (427)..(427): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagttatttttacagctcaaacaataaggacttctagcttggtatcagcaagaaaccagggcagcctcctaagctgctcatgtacgtgggcgtcgtacccgggaatccccggtcgtcctgacccgattcgaggtcgggcgggcgggtcgtggggacaggtatttcactctcaccatccagcacgcctgcagctagaagngtggtggactagtttattactgtacagctaaatattactctaactccggttcacgtttcggcgggtcgggaccgttaagggttcggaagatcgaagacgactggttggcg

SEQ ID NO: 334564 - DNA, 535 bp, Homo sapiens
  misc_feature: GZ8MTXP01EJ96O.25.38.D05.1.454.CMB.2.raw
  modified_base (270)..(270): a, c, t, g, unknown or other
  misc_feature (270)..(270): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (533)..(533): a, c, t, g, unknown or other
  misc_feature (533)..(533): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggaagtccctgagactctcctgtgcaacatcnggattcgccttacagttaactttggcatccacgtcggtcccnccaggctccgaggcaaagggctagagtgggtntacttttagtgggacagtgatgggcaagtgaataaagcctaatgacagactcgtacaaggccncttcncatcncagacgacaacgcaaaggacgtacggttcctttagaacaaatagaaaacgcctagacgacccgaggacaacggcttatagttattactgttgcgagaagcaagtgaggagtggcgngg

SEQ ID NO: 334565 - DNA, 541 bp, Homo sapiens
  misc_feature: GZ8MTXP01AVIQQ.25.38.D05.1.454.CMB.2.raw
  modified_base (436)..(436): a, c, t, g, unknown or other
  misc_feature (436)..(436): n is a, c, g, or t
  modified_base (514)..(514): a, c, t, g, unknown or other
  misc_feature (514)..(514): n is a, c, g, or t
tcagactgtacagtcacgaccggtgctcgatttagtatctgatagttgggtttgggggagctacaacaggcaggcaggggcagcaagatggtgttgcagaccccaggtcctcatttctctgttgctctggatctctggtgcctatggggacatcgtgatgacccagtctccagactccctggctgtgtctctggcgagagggccaccatcaactgcaagtccagccagtagttatttttacagctaccaaacaataaggacttctagcttggtatcagcagaaaccaggcagccctctaagctgctcatgtacgtggccgtcgtacccgggatcccccggtgtcctgacccattacaggtgggccgggcggggtcctggggacctaggtatttccacttctaccaccatccaagcagccctgcagggctagaaagngtggtggtctagtttaatcgtgtcagctaattattactactaactcgttctacgttcggcgggtacggaccgttaggnggtaagactcgagacgatggttggtcg

SEQ ID NO: 334566 - DNA, 491 bp, Homo sapiens
  misc_feature: GZ8MTXP01CPBK3.25.38.D05.1.454.CMB.2.raw
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctacaacaataaggacttctagcttggtatcagcagaaaccaggcagcctcaagctgctcatgactggctcaccgggatccccggtgtcctgaccgattcagtggcggcgggtctgggacagattcactctcacatcagcagcctgcaggctagaacgagtgtggactagtttatactgtcagctaatatatactaactcgttctacgttcggcggcggacgaggttgaagatcgagtacgacgtgttggc

SEQ ID NO: 334567 - DNA, 551 bp, Homo sapiens
  misc_feature: GZ8MTXP01E0HYO.25.38.D05.1.454.CMB.2.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (413)..(413): a, c, t, g, unknown or other
  misc_feature (413)..(413): n is a, c, g, or t
  modified_base (480)..(480): a, c, t, g, unknown or other
  misc_feature (480)..(480): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctggggttttcctcgttgctctttttaagaggtgtccagtgtcaggtgcagctggtggagtcgtgggggagcgtggtccagcctgggaatccctgagactctcctgtgcaacatcnggattcgccttcagtaactttggcatcccacgtggggtcccnccaggcctccgaggccaaggggactaggagtggggtntacttttagtgggcagtgatggcaagtgaataaagcctatcgcagacctccgtcgaacgggtccncttctccatcctccagacgacaacgaccaaagggaacgtacgttcctttagacctaaatagaaaacnccgtagacgaccgaggacaacggcttangttattactgttgcgagaanccaagtgagacgtggcgtaaggg

SEQ ID NO: 334568 - DNA, 568 bp, Homo sapiens
  misc_feature: GZ8MTXP01CTH3K.25.38.D05.1.454.CMB.2.raw
  modified_base (314)..(314): a, c, t, g, unknown or other
  misc_feature (314)..(314): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgacccagtctccagactccctggctgtgtctcgtgggcgagagggccaccatcaactgcaagtccagccagtagttatttttacagctaccaaacaataaggtacttctagcttaggtatcagacaagaaaccgaggcagcctactaagctgctnatgtacgtggccgtaccgtaccggaatccccggtcgtcctgaccgacttacgagtcgggcgggtcggtcgtgggacagtacttcactctacacccancancacgccngacgagntagagtggtgtgtattagtttactcgagtacaatactaaattacttaactacctaaccgttccggttacgtaccggttccggggacggaacgggttacgagggttcggaagtacgtaacgaacggacgttacgtggcgcg

SEQ ID NO: 334569 - DNA, 563 bp, Homo sapiens
  misc_feature: GZ8MTXP01DC2BF.25.38.D05.1.454.CMB.2.raw
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagactgtacagtcacgaccggtgctcgatttagtatctgatagttgggtttgggggagctacaacaggcaggcagggggcagcaagatggtgttgcagacccaggtcctcatttctctgttgctctggatctctggtgcctatggggacatcgtgatgacccagtctccagactccctggctgtgtctcgtggggcgagagggccaccatcaactgacaagtccagccagtagttatttttacagactacaaacaataaggacttactagcttggtatcagcaagaaaccagggcacgcctacgtaagctgctcatgtacgtgggccgtccgaccgggactcccccggtcgtccgtgaccctattcgaggtcgggcggcgggtcgaggggacaggtactttcacttctaccacatcacgtcgacgcctgacaggntagaagnggtggtaggtacttaggtttatacgtgtacaagtactaattattaactactaacgtcgttacgtacgttcgggacggcgggacgttgggttcgaagtatgaagacgttagtcgttggtc

SEQ ID NO: 334570 - DNA, 652 bp, Homo sapiens
  misc_feature: GZ8MTXP01EC5AR.25.38.D05.1.454.CMB.2.raw
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (372)..(372): a, c, t, g, unknown or other
  misc_feature (372)..(372): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgcaagtccagccagtagttatttttacagctacaacaataaggacttctagcttaggtatacagcaagaaaccngggacaagcctcctaagctgctnactgtacgtgggtcctacgacccgggaatcccccggtgtcctagacccgatttaccgggnggtcgggcgggtcgggtcggtacgggactagtacttccactcctaccaacctagtaccgacgtaccacgtccgtcgacgaaggtactaagaaggtggtacggtacggtaactttaagtttaactacgtgtacgtaacgtaactaaattaacttaacttaaccgttaaccgttaccggttaccggttaccggttaccgggtaccgggtaccgggttaacgggttacgggttacgggtaacggtacgtaacgaacggtacggttaacgtaacggttcggtcg

SEQ ID NO: 334571 - DNA, 742 bp, Homo sapiens
  misc_feature: GZ8MTXP01DX920.25.38.D05.1.454.CMB.2.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
tcagactgtacagtcacgaccggtgctcgatttagtatctgatagttgggtttggggagctctgggagaggagcccagcactagaagtcggcggtgtctctattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggaagtccctgagactctcctgtgcaacntcnggacttcgccttacagttaactttggactatcccgacgtcggggtcccacccaggtcctaccgaagggacccgaaaagggggtaccttaaggaggttgggggttattaaccgttttttaaggtcggggactaagttggaacgttcgggactaagggtggtaaattaaaacgggcccttaaagtcggacgtaacgtaacccgtttcccgacggtaaacggggcccgttctttacccgtaccctaacttcctacccgaaagaaccgggaaaccctaaaccggaaccccgaaaagggggtaaacggtaacccggggtttacccttttaggaaacctaaaaagttacggaaaaaccgtacccgtaggaaacccggaacccggaacgggaaccgtaacgggtacttaagttacggttaatttaaccgtggttagaccggaggtaacgccgaaggtggaggttagtcgggcgtaaggg

SEQ ID NO: 334572 - DNA, 610 bp, Homo sapiens
  misc_feature: GZ8MTXP01CYBOD.25.38.D05.1.454.CMB.2.raw
  modified_base (444)..(444): a, c, t, g, unknown or other
  misc_feature (444)..(444): n is a, c, g, or t
  modified_base (579)..(579): a, c, t, g, unknown or other
  misc_feature (579)..(579): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgaggacgggccaccatcaactgacaagtccagccaagtagttatttttacagctaccaaacaataaggtacttctagcttggtatcagacaacgaaacgaggcagcctacaagctacgctcattcgtacgtcgggaccgtaccgtacccgggtaacttcccccgggtacgtccgtacgtacccgtacgttacgacgggttcggggccgggtacgggtcgtagggactaggtactttcactctacactntcgagctacgctgcagtctagaacgtagtggtggtacttaaggtttactacgtgtactaacgtactaaatttagtactactaaccgtcgttacgttacggttcgggacgggcggttaacgttggttcggaacganaaccgtaaaggacgttactgggttaacgccg

SEQ ID NO: 334573 - DNA, 744 bp, Homo sapiens
  misc_feature: GZ8MTXP01C5E85.25.38.D05.1.454.CMB.2.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtctgggttttcctcgttgcttcttttaagaggtgtccagtgtcaggtgcagctggtgagtcgtgggggagcgtggtccagcctgggaatccctgagactctcctgtcgcaacntcgnggtattcgccttcaagttaactttggcactcccgacgtcgggtcccnccgaggctccgaggtcaaagggctaggaggttggtgtacttttagtggggactagtggaagttcgggactaagggttagaaacgttaaaaacgggtcccttaaagtcggaaccgaaacgggtacccctttacccgggtaaccggaaaccgggggtccccgttaacctttttccccgaccccttaaacgttccctaaccccgaaaggtaaaccgaaacccgttaaaacccggaccccgtaaaaagggggtaaacgggttaccccggggttttaacccttttaggaaaccctaaaaagtacggaaaaacgttcccgtacggaaaccggaccccgggtaaaggaacccgtaacggggtcttaagtagttacctttaaacggtggttacgacgagaacgtacgaaggtaggaggttaggtcgaacggtggg

SEQ ID NO: 334574 - DNA, 601 bp, Homo sapiens
  misc_feature: GZ8MTXP01B2XLU.25.38.D05.1.454.CMB.2.raw
  modified_base (199)..(199): a, c, t, g, unknown or other
  misc_feature (199)..(199): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtncagctggtggagtcgtgggggagcgtggtccagcctgggatccctgagactctcctgtgcaacntcnggatcgccttnagtacttggctatccagtggtccncaggcctccgaggccaagggactagacggtgggtntactttttagngggctagtgatggcaaggtgaaataaaggcctaatggacagactccgtacgaagggccgtacttctaccactcctaccaagacgaacgaaaccgtcaaaggggaacgtaccgggtttacctttaggacctaaaagtacggaaacgtcccgtaggaacggaacccggaacggccgtaaacgggtcttaaagttggttaaacttacgtggttcggcggaaggaagccgtaaggtggaggacggttggccgtaaggg

SEQ ID NO: 334575 - DNA, 764 bp, Homo sapiens
  misc_feature: GZ8MTXP01BQB8W.25.38.D05.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtgagtcgtgggggagcgtgtccagcctgggatccctgagtactctcctgtgcaacatcnggattcgccttanagttaactttggctatcccacgtcggtccncaggctccgaggccaagggtactaggacgttggggtctaccttttttagtggggactagtcggattcgggactaaggttacgaaattaaaacggcccttaaagttcgggacctaaacggtacccttacccggtaccggtaaacggggtccccgtaccgtttcccgtacccgttaactccgttaccccgaaggtaaccgaaacccgtaaaccggaaccccgtaaagggggaaacggtaacccggggtttacccgtttttaacgggaaacctaaaacgttaacggaaaaaaccggtcccggttaacggaaacccgggaaaccccgggaaacgggtaacccgaaccgggttaccttaaaggttacgggtttaaacgtttaaccgtgggttacggccggagggtaacggtacccgaagggttcggaagggttaacgggttgggaacccgttaaggggg

SEQ ID NO: 334576 - DNA, 668 bp, Homo sapiens
  misc_feature: GZ8MTXP01EYCDK.25.38.D05.1.454.CMB.2.raw
  modified_base (271)..(271): a, c, t, g, unknown or other
  misc_feature (271)..(271): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctggagcgtgggttcgtccttagttgctattttagaagtgtccagtgtgaggtgcagttggaggagtcgtgggggagcttggtccaggccgggggggtccctgagactctcctgtgcagcctntggattcagtttagcagtattttggatgagctgggtccnccgaggccccgagggggaagggcgtggtgtgggtagccaaanatacgagaagagtaggaggtagaagtaaaatataagtcggacgtactgtaggtagggacgggtccgtactaccactacgtactaccgaaggaaccaacctaaccaaacaacgtactaagttaatactcggtagtaactaaagtagtaagttcggtacgtaggaacggacggaccggaacgggtaccgacgggtcgttaggtttaggtttacgtttacggttaggtacggttacgggttacgggttaccgggtaacccggtaaccccggtaacccgtaacccgtaaccgttaaccgttaacccgtttaacgttaacg

SEQ ID NO: 334577 - DNA, 727 bp, Homo sapiens
  misc_feature: GZ8MTXP01AWWQT.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaacaataaggtacttctagcttggtatcagcaacgaaaccgagggcacgcctactaagctgctcatcgtacgtggccgtaccgtacccgggaactcccccggtgtacccgtggacccgtacttcgacgggtgggccgggtccgggttacggtcggggaactacggtattttacccaacttcctaccaaccctagttccaacggccaacggtccccgttggaccgtaacgggccttagggaaaacgtagggttgggttacggggtactttaaccgggtttttaagttaccccttaggttaccgaaacgtaacttaaactttaattttaacctaacccgtttaacccgttcccgggttacccttaaaccgggttttccgggaacccgggggtacccggggttaaacccggttaaggggttaggggaaacttcggttaacccgtaaaggggaacccgttaacggttggttcgggggtaacccg

SEQ ID NO: 334578 - DNA, 554 bp, Homo sapiens
  misc_feature: GZ8MTXP01EP7MA.25.38.D05.1.454.CMB.2.raw
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (475)..(475): a, c, t, g, unknown or other
  misc_feature (475)..(475): n is a, c, g, or t
  modified_base (528)..(528): a, c, t, g, unknown or other
  misc_feature (528)..(528): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgcaagtccagccagtagttatttttacagctaccaaacaataaggtacttctagcttggtatcagacaagaaaccgagggacagccctactaagcctagctcattgtacgtggtcgtaccgtacccggggtatcccccggtgtaccgtgaccgtattccgaggtcgggcgggtcgggtctggggacctaggtactttcactctacacatcagacacgtccgngcgagngagagaggtgtagtagttagttatacgtgtanatactaattattactactcgtcgttcgtcggttcgggacggtacggacgaggngaagagtaacgagacgagtcgttcgc

SEQ ID NO: 334579 - DNA, 792 bp, Homo sapiens
  misc_feature: GZ8MTXP01A9QE2.25.38.D05.1.454.CMB.2.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaatccctgagactctcctgtgcaacatcnggattcgcttcagttaactttggacatcccagtcgggtccnccaggcctccgaggcgaagggactagnggtgggtgtactttttagtgggcagtggagttgggactaagggtagtaaacgtaaaagggcccttaaagttcggacctaacggtaacccgttcccgggttaccggaaaacggggggtccccgttaccgtttcccgttaccccgtacttacccctacccgaaacggtaacgaaacccgtaaacccggtaaccccgaaaaacgggggtaaacggggttaacccggggttttaaccctttttacgggaaaccctaaaaagttaaccggaaaaaacggtaccccgttaaggggaaacccggaaacccccgggaaaggggtaaacccggaaacccggggttacctttaaacgttgggtttaaaccgtttaaaccggtgggtttaaccggggccggttaaagggtaaccggtacccggtaagggttagggaacgggaaggggttcggaaccgggtaaggggg

SEQ ID NO: 334580 - DNA, 640 bp, Homo sapiens
  misc_feature: GZ8MTXP01CXZXF.25.38.D05.1.454.CMB.2.raw
  modified_base (331)..(331): a, c, t, g, unknown or other
  misc_feature (331)..(331): n is a, c, g, or t
  modified_base (465)..(465): a, c, t, g, unknown or other
  misc_feature (465)..(465): n is a, c, g, or t
tcagactgtacagtcacgaccggtgctcgatttagtatctgatagttgggtttggggagctctgggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggtcagcgttagcacagctacttgatcgtcgggtccgccaggctaccgagggggaaggggcngggagtgcgtctctagtttattatagacgaataaaactaccaacctactacgcacgacctcgtagaaacggggccctattcccttaatccgtaccaagaacgtaaccaaacttcccgaaggaaacctacccctntaacttacggttacaaaagttcgaaacccgtcccgtaggaacgacgaccggaggaaccacgggcccgttaggtaacttaaccgttggtcggcggtcgggggaattacgttacgttaggttaagggtttatttaacggaactttaccgttacctttcccgttaacggttccggggg

SEQ ID NO: 334581 - DNA, 629 bp, Homo sapiens
  misc_feature: GZ8MTXP01BYU6H.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgaccagtctccagacctccctggctgtgtctcgtgggcgagacgggccacatcaactgacaagtccagccagtagttatttttacagtctaccaaacaaataaggtacttctagtcttaggtactcagacaaggaaaaccaggggcacgccctacctaagctagcctcatcgtacgtgggtaccgtaccgtaacccggggtaacttcccccggtccgtaccgtacggtaacccgtagttcgacgggttcgggccggggtcggggttccgtggggaacctacggtacttttccacctctaccaacctactcgacgacacgtcccggtgacgacgtacgtaggaagtcggtgtacggtactttagtttacgtactgtacgatactaattactactacttaaccgtccgttcgtacggttccggacgggtacggaacgaggttagaagagtaagaagaagttacgtggcgtcg

SEQ ID NO: 334582 - DNA, 640 bp, Homo sapiens
  misc_feature: GZ8MTXP01CCBEU.25.38.D05.1.454.CMB.2.raw
  modified_base (269)..(269): a, c, t, g, unknown or other
  misc_feature (269)..(269): n is a, c, g, or t
  modified_base (321)..(321): a, c, t, g, unknown or other
  misc_feature (321)..(321): n is a, c, g, or t
  modified_base (601)..(601): a, c, t, g, unknown or other
  misc_feature (601)..(601): n is a, c, g, or t
  modified_base (614)..(614): a, c, t, g, unknown or other
  misc_feature (614)..(614): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttccctcgttgcttcttttaagaggtgtccagtgtcaggtgcagctgggtggagtcgtgggggagcgtggtccagccgtgggaatccctgagactctcctgtgcaacntctggattccgcctttacagttaactttggctagtcccacgtcgggtccccnccgaggcctacccgagggaccaaaggggctaggaggtgggtgtactttttagtggggctagtgagtgggactaaggtagaaataaacggcctagtcggacgacgtaccgtcccgtacgaacggggccctcctttcaccctacttccaccgaacgacgaaccgaaaccgacccgaaaggggtaaacggtaccggtttacctttaaggaacctaaaagttacggaaaacgtcccgtaaggaaccgaacccggaggaccgaacggtcttatacgttattacgnggttcgacgacgngacgtgtggagaggtggaacgtcggg

SEQ ID NO: 334583 - DNA, 535 bp, Homo sapiens
  misc_feature: GZ8MTXP01CFFTR.25.38.D05.1.454.CMB.2.raw
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggtgacatcgtgatgacccagtctccagactccctggctgtgtctcgtgggcgagagggccacatcaactgacaagtcagccagtagttatttttacagtctaccaaacaataaggtacttctagtcttggtatcagcaagaaccnggcagcctactaagctagctcatgtacgtggctcgtaccggactccggtgtccctgaccgtaattcgnggtcgggcgggtcgggtgngggactagtctttcactctcacatcagcagcctgcagctagaagntggngactatttcgtactgtacagtactaattattaataactacgttcgtcttacggtttcggcggttacgggaccgttagggtggagtctcggacgacgtaacgttggtcgg

SEQ ID NO: 334584 - DNA, 670 bp, Homo sapiens
  misc_feature: GZ8MTXP01ASLZ5.25.38.D05.1.454.CMB.2.raw
  modified_base (182)..(182): a, c, t, g, unknown or other
  misc_feature (182)..(182): n is a, c, g, or t
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgctcttttaagnggtgtccagtgtcaggtgcagctggtggagtcgtgggggagcgtggtccagcctgggactccctgagactctcctgtcgcaacatctggattcgccttanagtaactttggctatcccagtgggggtccccncgagcctaccgaggacgaagggctaggnggtggtacttacgttttaggnggatagtgagtgggacgtgtagaagtaacgtacgtagtacgacgacgtaccgtaccgtacggacggtaccgtccgttcctacctactacctaccgacgacgaacgaaccgaaccgaacgggtaacggtaccggttaccgttacgtaacgtaaacgtaacgtaaacgtaccgtacgtaaccggaacccggaaccggaaccggtaaccggtaacgttacgttacgttacgttacgtacggttacggttacggacggaacggtaccgtaacggtacggtacgggttacgggtaacgggttcggtaacggg

SEQ ID NO: 334585 - DNA, 654 bp, Homo sapiens
  misc_feature: GZ8MTXP01CQAPV.25.38.D05.1.454.CMB.2.raw
  modified_base (531)..(531): a, c, t, g, unknown or other
  misc_feature (531)..(531): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgaggacgggccaaccatacaactgacaacgtccagcctagtagttatttttacagtactaccaaactaataaggtacttcgtagtcttaggtatacgagacaaacggaaaccgagggaccacggtaccccttacgaaacggtcctagtcctacgtacgttcggtaaccggtggggtacccgttaccggtaaccccgggggtaacttccccccggggtaccgttaccgtaccggaacccgtacgttaacggacgggttcggggccggggtccgggtcggtaggggacctaggtactttacacgttcacctaccatccaagcacggcctgaccaggntagaagtgtcggtgtacttagttactgtgtacactataatatactccgtcgtcgttacgtcggttcgggacggacggttaacggttggacgtaagtacgtaacgaagtacgttacgtcgcgtg

SEQ ID NO: 334586 - DNA, 572 bp, Homo sapiens
  misc_feature: GZ8MTXP01A484Q.25.38.D05.1.454.CMB.2.raw
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
  modified_base (519)..(519): a, c, t, g, unknown or other
  misc_feature (519)..(519): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggatccctganactctcctgtgcaacntcnggattcgccttnagttacttggcatccacgtgggtcccncgaggcctaccgagggtaccaaaggggactaggaggttggggtatactttttagtggggactagtgatgggcaaggtnaaattaaagccttaagngacagactccgtacgaacgggcctcttctaccatcnccagacgaacaacgaccgaagggaacgtcggttacctttagacaaatagaaacgccgtagacgacccggaggacaacggnttagtcgttattacgtgttcggngagngccgaagtgaggacgtggcgtaaggg

SEQ ID NO: 334587 - DNA, 648 bp, Homo sapiens
  misc_feature: GZ8MTXP01BGADH.25.38.D05.1.454.CMB.2.raw
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggtttttcctcgttgcttcttttaagaggtgtccagtgtcaggtgcagctggtggagtcgtgggggagcgtggtccagccgtgggaactccctgagactctcctgtgcaacntcnggattcgccttnaagttactttggcatccacgtcggtccnccgaggctccgaggcaaaggggctaggagtgggtntacttttagngggctagtgagtgggacaaggtagaaataaacggccttaagtcgacaacgtaccctccggtacgaacggggtccctacctttccctacccacttcctaccgaacggaacgaaccgaaaccgacccgaaaggggaacggtacccgggtttacctttacggaactaaagtaacggaaaacgccgtaagaaccggaacccgacggaacgaacggtacttaagttacgttacgttaacgtggttacgcggaacgaacgtaccgaaggtaggagttaggtcggttaacgtaaggg

SEQ ID NO: 334588 - DNA, 599 bp, Homo sapiens
  misc_feature: GZ8MTXP01DLIWE.25.38.D05.1.454.CMB.2.raw
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
tcagactgtacagtcacgaccggtgctcgatttagtatctgatagttggggtttgggggagctacaacaggcaggcaggggcagcaagatggtgttgcagaccccaggtcctcatttctctgttgctctggatctctggtgcctagtggggacatcgtgatgacccagtctccagactcccgtggctgtgtctcgtgggcgagagggccaccatcaactgacaagtccagccagtagttatttttacagctaccaaacaataaggtacttctagcttaggtatcagacaagaaaccaggcacgcctacaagctgctacatgtacgtggcgtaccgtaccggactccccggtcgtcctcgaccgtntacgaggtcgggcgggtcgggtcgtgggactagtactttccactctaccaccatcgacgcgacgtcctgacgngacgtagaagtagtggtcggattagtttatcgtgtacatactaaattattaactacgtaaccgtccggttacgttaccggttcgggaccgggaccgggaaaccggttagggttagggtaactacgtaacgaaacgtacggttaacgtggttcgggtaaccc

SEQ ID NO: 334589 - DNA, 952 bp, Homo sapiens
  misc_feature: GZ8MTXP01CJF92.25.38.D05.1.454.CMB.2.raw
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggttttcctcgttgcttcttttaagaggtgtccagtgtcaggtgcagcgtggtggagtcgtgggggagcgtggtccagccgtgggaactccctgacgtacctctcctgtcgacaacatcgtaggtacttccggtaccctttacgaaggtttaaaccttttgggacctaacgttcccccgaacggttcgggggtcccccgaccccggtaacggggtccccttaccccggaagggggtacccgaaaaaggggggtaccgttaagggtaagggttcggggggtttacgtttaaccgtttttttaaggtcggggggctaaggttggtaaaggtttcgggggaaccttaagggttacggtaaaaacgtttaaaaccgggtccccttaaaagttcgggaaaccgtaacgggtaaccccgtttacccgggttaaccggaaaccgggggtccccgttcccgttttacccgtaccccttaacgttacccgttaaccccgaaacggaaccgtaaacccgaaacccgggaaaccccgtaaaagggggtaaaccggttaacccggggtttttaacccctttttaaggaaacccgttaaaaaggttaacggtaaaaaaccggtcccggttaaacggtaaaccccgggtaaccccgggtaaacgggaacccgtaaaccggggtaacttaaaccggttttaagggttaaacctttaaaccggtggttaacgggaccggttaacggtaacggacccggtaaggttacggggaacggttagggttaaccgggttaaccgggttaacggggg

SEQ ID NO: 334590 - DNA, 713 bp, Homo sapiens
  misc_feature: GZ8MTXP01BIMSQ.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgacaagtccagccagtagttatttttacagtctaccaacaataaggtacttctaagcttaggtatcagacaagaaaccgagggacacgccctactaacgctagctcaagtgtacgtgggtccgtaccgtaacccggggtaactcccccgggtcgtccgtacggtacccgtatttaccgaacgggttcggggccgggtccgggggttccgttacgggggaactaagggtacttttcccaactttcctaccaacccaatccgaggaccacgtcctaggccgaagggtctaagggaaacgtaggttgggtacgggtaccttaagggtttttaactaccgttaggtacctaaaggtaccttaaaatttaactttaacgtaacccgttaacccgttacccggggttcttaaccggtttcgggggacccgggtaccgggttaaaccgttaaggggttccggaaagtacgttccgaaggtaacgaaccggttggttaacggcccg

SEQ ID NO: 334591 - DNA, 593 bp, Homo sapiens
  misc_feature: GZ8MTXP01A0XAI.25.38.D05.1.454.CMB.2.raw
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtncagctggtggagtcgtgggggagcgtggtccaggcctgggaatccctgagactctcctgtcgcaacatctggacttcgccttnagttaactttggcatccacgtcgggtccnccaggcctccgaggccaaggggactaggagtggggtgtactttttagtggggctagtggagtgggctaaggttgaaacttaaaaggcccttaagtcggacaacgaccgttccggtacgaacgggcccgtcttctaccactctaccagacgaccgaacgaccgaaaggaacggtacggttcctttagactaaatagaaacgctagaaccgaccgaacgacaacggacttagtagttagttacgtgttagcgaggaatccgaagtggaggacgtggcgtaagg

SEQ ID NO: 334592 - DNA, 690 bp, Homo sapiens
  misc_feature: GZ8MTXP01EWUVO.25.38.D05.1.454.CMB.2.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggttttcctcgttgcttcttttaagaggtgtccagtgtcaggtncagctggtggagtcgtgggggagcgtggtccagcctgggaactcccgtgagactcctcctgtcgacaacatcgtggtacttccgccttacagttaactttggactactcccacgtcggtcccgacaggctaccgaggaccaaagggtactaggagtggggtatacgtttttaggnggatagtgagtggactaagtacgaaagtaaacgctagtcgactacgtaccgtaccgtacggacgggtcctcttcctaccctactccgaacgaacgaacgaaaccgtaaaccgaaccgaaacggggtaacggttaccggtttaccttaacgaaacgtaaaacgtaaacgtaaaaccgtaccgtaacggaacccggaaccggaacggaaccggaacggttaacgttaagttacgtttaaacgttacgttaggttacggacggttacggaacggtacggtaaggtacggtacgggttacggtcggttcggtaacgg

SEQ ID NO: 334593 - DNA, 677 bp, Homo sapiens
  misc_feature: GZ8MTXP01BCO5F.25.38.D05.1.454.CMB.2.raw
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagactgtacagtcacgaccggtgctcgatttagtatctgatagttgggtttggggaggtctcagagaggagccttagccctggctccaaggcctttccacctggtgatcagcactgagcacagaggactcaccatggaattggggctgagctgggttctccttgttgctatttagaaggtgtccagtgtgaggtgcaggttggaggagtcgtggggggaggtcgttggtccgaggcccgggggggtccctgagactctcctgtgcaggcctctggattcagttttagcagtattttggatggagctgggtccnccaggccccgaggggagggctgggtgtggggtancctaanatacgacgtaaagntagggagtacgaagaaaaatctaagtcggcggtactcgtagtaggaagggtcccgattacaacctagtccctaccgaaggggaacaaacctaccaaaactaacttacaagtaattacgtctagtaacctaaaagtgaaagttggtacctaggaacggtagtacccggggaaacgggtaccgaacccggggttcgttacggttacgtttacgtttcgtacgggttacgggacggttaacgggttaccggtaacccggtaaccccgtaaacgtaccctaacgttaaacccggtaacccgtttaaggttcg

SEQ ID NO: 334594 - DNA, 666 bp, Homo sapiens
  misc_feature: GZ8MTXP01DOOA4.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgaggacgggccaccatcaactgacaagtccagccagtagttatttttacagctaccaacaataaggacttctagcttaggtatcagacaagaaaccgagggaccacgcctacctaagctgctcatgtacgtgggtccgtcgtacccgggaactcccccggtacgtccgtgacccgtattaccgaggttcggggccgggtcggggtcgtaggggacctaggtactttaccaccttctaccaccctaacgtacgacgaccgacgtccgtacgacgacgtacgtaaggtaacgtagggtcggtacggttactttaagtttactacgtcgtaacgtaaactacttaaattaacttaaccttaccgttaacccgttcccggttaccgttaccgggttcggggaaccggggtaacgggaaccgttaaggggttacggaagtacgtaacgtaaacggtaccgttacgttcggcgtcg

SEQ ID NO: 334595 - DNA, 539 bp, Homo sapiens
  misc_feature: GZ8MTXP01DXALQ.25.38.D05.1.454.CMB.2.raw
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtggcgagagggccaccatcaactgcaagtccagccagtagttatttttacagctaccaaacaaataaggtacttctagcttaggtatacagcaagaaaccgnggacacgcctactaagctgctcatgtacgtggcgtacgtaccggatcccggtcgtccngaccgtattcgagtcgggacggcgggtccgtagggacagtactttcacttcacaccatccaggcacgctgcagctagaanggtgnggtctaagtttntacngtcagtctaaatntactntaactcggttctacgttcggcggtaccggagagggttgaagtctaacgagaccaacgtcggttgaaccc

SEQ ID NO: 334596 - DNA, 703 bp, Homo sapiens
  misc_feature: GZ8MTXP01AJWVT.25.38.D05.1.454.CMB.2.raw
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagagactcaccatggagtttgggctgagtcttgggttttcctcgttgcttcttttaagaggtgtccagtgtcaggtgcagctgggtggagtcgtgggggagcgtggtccaggccgtgggaactccctgacgtactcctcctgtgcaaacntcgtggtacttccgccttnaagttactttggactacttcccgacgttcggggtcccnccgagggcctaccgaggacaaagggggtactaggtaggtggggttagtaccgtttttaggtggggactagtggattgggacctaaggttagaaattaaaacggcccttagtcgacaagtaaccgttccggtacgaaacggggtcccctctttaccccgtaccctactcctaccgaacgaacgaaccgaaccgtaaccgaaacggggtaacggtaccggtttacctttaacgaaactaaagtaacgaaaccgtccgtaacggaaccgaaacccggacggaaccgtaacggtacgttaagtacgttaaacgttacgtggttacggacggacgaaccggtacggtaaggtacggtagggacggtggcggtaacgg

SEQ ID NO: 334597 - DNA, 639 bp, Homo sapiens
  misc_feature: GZ8MTXP01B681V.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagacgggccaccatcaactgacaagtccagccagtagttatttttacagacctaccaaacaataacggtacttctagcttggtatcagcaagaaaccaggcacgccctactaagctgctcattcgtacgtcgggtccgtaccgtaccccggggtaacttcccccggtcgtcccgtagtacccgtacgttcgacggtcggggccgggtcgggtcgtacggggactaggtactttccactctaccacatcacgtacacgcctgccgagcgtagaagtagtggtggtacttagtttataccgtgtactaagactaaattacttaactccgttaaccgttccggttacgttaccggtttaccggggaccgggtacggggttaaacccgttaaggggttacgaaacgtacgtaacgaacggtaacgttaccgtgggttcggtaaccg

SEQ ID NO: 334598 - DNA, 690 bp, Homo sapiens
  misc_feature: GZ8MTXP01ENW1U.25.38.D05.1.454.CMB.2.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggtttttcctcgttgcttctttttaagaggtgtccagtgtcaggtgcagctggtggagtcgtgggggaggcgtggtccagccgtgggaacgtccctgagactctcctgtgcaacatcnggacttcgccttanagttaactttggctactcccacgtcgggtcccgccaggcctcccgagggaccaaaggggtactaggaggttggggtagttaacttttttaggtggggactagtggaagttgggactaaggttagaaagtaaaacggtcccttaaagtcggactaaacggtacccgttacccggtaaccggtaacggggccccgtacctttccctaccctactccgtaccaaggaacgaaccaaaccgacccgaaaggggtaaacggtacccgggtttacctttacggaaactaaaagtaacgaaaacgacccgtaggaaccgaaccccggagggaaccgtaacggtcttaagtagttaacttacgtggttcgacgaggtaacgcgtaaggtggaggaggtcggcgtaaggg

SEQ ID NO: 334599 - DNA, 632 bp, Homo sapiens
  misc_feature: GZ8MTXP01CGX63.25.38.D05.1.454.CMB.2.raw
  modified_base (360)..(360): a, c, t, g, unknown or other
  misc_feature (360)..(360): n is a, c, g, or t
  modified_base (454)..(454): a, c, t, g, unknown or other
  misc_feature (454)..(454): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtgggacatcgtgatgacccagtctccagactccctggctgtgtctcgtggcgagagggccaccatcaactgacaagtccagccaagtagttatttttacagtctacaaacaataaggacttctaagtcttaggtactcagacaacgaaaccaggcacgcctacctaagcctagctacaatcgtacgtggccgtacgtacccgggaatcccccggtntccgtgaacccgtagttaccgaggttgggccgggtcgggtcgtacgggacagtaactttccaactttcacaaccaatacgacgccgacgttcgngacgacgacgtagtagtaggtagtagtacgttacgttacgttacgtacgtacgtacgtaactaacttaacttaacgttaaccgttaaccgtaccgttaccgtaccggttaccggtaccgggtacggacggttacggttacggtaagtacgtaacgtacgtacgttacgtcgttcgtcg

SEQ ID NO: 334600 - DNA, 627 bp, Homo sapiens
  misc_feature: GZ8MTXP01CD309.25.38.D05.1.454.CMB.2.raw
  modified_base (460)..(460): a, c, t, g, unknown or other
  misc_feature (460)..(460): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggtgacatcgtgatgacccagtctccagacctccctggctgtgtctcgtgggcgagagggccaccatcaactgacaagtccagccagtagttatttttacagctaccaacaataaggtactcttagcttggtatcagcaagaaaccgagggcacgcctactaagctgctacatcgtacgtcgggccgtaccgtacccggtaacgttcccgggtcgtccccgtagacccgtaaattccgaagggtcgggcccggggtcgggtcgtaggggacctaggtactttccgaactctacaccatccgaacgtcacgtcccgngcgaggtacgtagaggtgtggtagtacgttagtttactcgtagtacagtattaattacgttaacttaaccgtacgttcccggttacgttacgggttaccgggccgggttaccgggaacggttagggtaagtacgtaacgtacgaacggttaccgtaacgttcggtcg

SEQ ID NO: 334601 - DNA, 590 bp, Homo sapiens
  misc_feature: GZ8MTXP01CDG1I.25.38.D05.1.454.CMB.2.raw
  modified_base (368)..(368): a, c, t, g, unknown or other
  misc_feature (368)..(368): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgaggagggccaccatcaactgacaagtccagccagtagttatttttacagtctaccaaactaataaaggtacttactagtcttggtatcagcaagaaaccagggcacgcctacaagctgctcatgtacgtggccgtacgtacccgggaactccccggtcgtccgtgaccgtntcgaggtgggccgggtcgggtcgtgggactagtacttcactctacacatcgagcacgctgcgagtctagaagtgtggtgcttagtttatacgtgtacaagtctaaattattaactccttaacgttcccggttcgttaccggttccggggaccgggaccggggttaaccgaaggggttcggtaagtacgtaacgaaaggtagttaaccgttgggcggtaaccg

SEQ ID NO: 334602 - DNA, 619 bp, Homo sapiens
  misc_feature: GZ8MTXP01AJ6W4.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagttatttttacagctaccaacaataaggacttctagcttggtatcagcaagaaaccagggcagccctacctaagctagctcatgtacgtgggcgtcgtacccgggtactccccggtcgtccgtgacccgtattacgaggtcgggcgggcggggtcgtcggggactaggtacttttaccacctcctaccaaacctacttaccgaacggcaacgtccccgtaggccgaacgggccgtaggaaagaggttggtacgggtccttaggttttaataccgttgacctaagtactaattattaacgtaccgttaactcccggttctaaccgtttcggggaccgggtaccgggacgttaggggttgaagtcaacgaggacgttaacgtggttcggtc

SEQ ID NO: 334603 - DNA, 629 bp, Homo sapiens
  misc_feature: GZ8MTXP01ACT7I.25.38.D05.1.454.CMB.2.raw
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaactccctgagactctctgtgcaacntcnggatcgcttnagtactttggcatccagtcggtccncaggctccgaggcaaggctagnggtggtntacttttagngggntagtgactgggcaaggtnaaactaaagcctagtgacagacctcgtacgaacgggccgtcttcctaccacttccgaccgaagaacgaaaccgaaaccgtacccgaaaaggggtaaacggtaaccgggtttaccctttttaacgggaaaccaaaagttaacggtaaaacgaccccgtaggtaaccgaaccccggaagtaaccgaacgggtccttaagttgttaattaccgtaggttgaccgagaacggacccaagggttggacggttaggggtcggcggtaacgg

SEQ ID NO: 334604 - DNA, 623 bp, Homo sapiens
  misc_feature: GZ8MTXP01CY0W2.25.38.D05.1.454.CMB.2.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggtttttcctcgttgcttcttttaagaggtgtcagtgtcaggtgcagctggtggagtcgtgggggagcgtggtccagcctgggaagtccctganactctcctgtgcaacatcnggattcgccttnagttaacttggcatccactgggtcccnccaggcctccaggcaaaggggctagagtgggtntactttttagtggggntagtgagtcgggactaagtnaaattaaagcctaagngcaagacctcgtacgaacgggcctcttcncatcctccaaggacaacgaaccgacccgaaaggggaaacgtacgggtttaccccttttaggaacctaaaacgtaacgtaaaacgtaccgaacggtaaccggaacccggaacggaaccgtaacggtacttaagttacgttaacgttacgtgttacgcgaggaacgacggtaaggtacggaggttacggtcggaacggtaagg

SEQ ID NO: 334605 - DNA, 620 bp, Homo sapiens
  misc_feature: GZ8MTXP01DJH2D.25.38.D05.1.454.CMB.2.raw
  modified_base (453)..(453): a, c, t, g, unknown or other
  misc_feature (453)..(453): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgacccagtctccagacctccctggctgtgtctcgtgggcgaggacgggccaaccatcaactgcaagtccagccagtagttatttttacagtctaccaaacaataaggtacttctaagtcttaggtatcagacaacgaaaccgaggcacgcctactaagctgctcatgtacgtggcgtacgtacccggtaactccccggtctccgtagaccgtagttacgaggtcgggcgggtcgggtcgtaggggactagtactttcactcctcaccatcacgcacgcctgcaggctagaaagngtggtggtacttaagtttataccgtgacctaagtactaaattacttaactaacgtaaccgttccggttctaaccggtttccggggacgggtacccgggttaaccgttaaagggttcgggaaatacgttaacggaaagggaagttaaccgttggggttaacggtcccg

SEQ ID NO: 334606 - DNA, 762 bp, Homo sapiens
  misc_feature: GZ8MTXP01ALE96.25.38.D05.1.454.CMB.2.raw
  modified_base (273)..(273): a, c, t, g, unknown or other
  misc_feature (273)..(273): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagttttgggctgagcttgggttttccctcgttgcttcttttaagaggtgtccagtgtcaggtgcagctgggtggagtcgtgggggagcgtggtccagccgtgggaatccctgacgctctcctgtcgacaaacntcgtggtacttccgtcctttacgaaggtttaaaccttttgggacctacgttccccgaccggttcgggggtacccccgccgaaggggtcccctacccggaagggggacccgtaaaaggggggtacctttaagggggacgggtttggggggttacgtttaaccgtttttttaaggttcgggggactaggttagggtaagttcggggacctaagggttagaaaacgttaaaacgggtcccttaagcgactaacgtaccgtaccgtacggaacgggtcccgtacttccctaccctactcctaccgaacgacgaaaccgaaccgaaccgaaacggggtaacgtacccggtttacctttaacggaaactaaagtaacgaaaacgtaccgtacggaaccgaacccggaacggaaccgaacggtacttaagtcgttaacttacgtggttacggcggacgaacgacgtaaggtggacggaggtaacggcgtaacgggg

SEQ ID NO: 334607 - DNA, 600 bp, Homo sapiens
  misc_feature: GZ8MTXP01AV729.25.38.D05.1.454.CMB.2.raw
  modified_base (286)..(286): a, c, t, g, unknown or other
  misc_feature (286)..(286): n is a, c, g, or t
  modified_base (367)..(367): a, c, t, g, unknown or other
  misc_feature (367)..(367): n is a, c, g, or t
tcagactgtacagtcacgaccggtgctcgatttagtatctgatagttgggtttggggaggtctcagagaggagccttagtcctggactccaaggcctttccacctggtgatcagcactgagcacagaggactcaccatggaattggggctgagctgggttctccttgttgctattttagaggtgtccagtgtgaggtgcagttggaggagtcgtggggggagcttgggtccgaggcccgggggggtccctgagactctcctgtgcagcctctggattcagttttanctagtattttggatggagtcgtcggggtcccgccgacgggccccgagggggaacggggctgggtggtggggtacaccaaanataacgacgaagagtagggagtagaagaaaaatctaagtgaccgggtatcgtaggtggaaacgggcctattccgaccatccgtacgacggaaccaactaccaaacaacttcaagtatactctagacaaagtgaattcggataggagacgccggaaggtacacggcttagttgttattcgtgtggcgaggttacgtccgaccccgtaatcccgtattacccgtaaccttgttcg

SEQ ID NO: 334608 - DNA, 698 bp, Homo sapiens
  misc_feature: GZ8MTXP01CDZZQ.25.38.D05.1.454.CMB.2.raw
  modified_base (220)..(220): a, c, t, g, unknown or other
  misc_feature (220)..(220): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (357)..(357): a, c, t, g, unknown or other
  misc_feature (357)..(357): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggttttcctcgttgcttcttttaagaggttgtccagtgtcaggtgcagctgggtggagtcgngggggagcgtggtccagccgtgggaatccctgagactctctgtgcaacntcgnggtacttcgccttcagttaacctttggctatcccagtcggtcccgccaggcctacgaggacgaagggacgtagacggttgggtntaacgtttttaggtgggactagttaggagttacgggactaaggtagaaagtttaaaacgggcctaaaggtcgactaacgtacccgtaccggttacggaacggggcccgtacttacctacctactacctaccgaagaaccgaaaccgaaaccggacccgaaaggggtaaacggtacggtttacccgttttacggaactaaaacgttaacgaaaacgtacccgtacggtaaccgacccggaaggaccgtaaccggtcttacttaaggttacgttaaccgtggttacgcgaacgaacggtacccgaagggttaggacggttagggttccgggttcggtaacggg

SEQ ID NO: 334609 - DNA, 674 bp, Homo sapiens
  misc_feature: GZ8MTXP01AICHV.25.38.D05.1.454.CMB.2.raw
  modified_base (271)..(271): a, c, t, g, unknown or other
  misc_feature (271)..(271): n is a, c, g, or t
  modified_base (325)..(325): a, c, t, g, unknown or other
  misc_feature (325)..(325): n is a, c, g, or t
  modified_base (652)..(652): a, c, t, g, unknown or other
  misc_feature (652)..(652): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggttgtccagtgtcaggtgcagctggtggagtcgtgggggaggcgtggtccagccgtgggactcctgacactctcctgtcgacaaacntcgtggtattccgaccttcaagttaacgtttggactatcccacgtcgggtcccnccgaggcctacccgagggacgaaaggggtactaggtaggttcggggtattactttttaggtcggggcaagttggagttcgggataaggttagaaacttaaaggcccttaagtcggactaacggtacccgttaccggtaaccgtaaccggggtcccgtcctttcctaccctacgtccctacccaaggaccgaaaccgaaccgaaccgaaacggggtaacggtaccggtttaccgtttacggaaaccttaaagaacgaaaacgtccgtacggaaccggacccggagacccgaacggtacttagtagttaatcgtgcgacgagaacggcnggtagagggagtcggcgtcggg

SEQ ID NO: 334610 - DNA, 693 bp, Homo sapiens
  misc_feature: GZ8MTXP01BGP7Z.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgaccagtctccagactccctggctgtgtctcgtgggcgaggacgggccaccatcaactgacaagtccagccagtagttattttacagtctacaaacaataaggtacttctaagtcttaggtatacgagacaacggaaaccgagggacacggtccctaccgtaaagcctgcctacagttacggtaccggtgggtaccgttaccggtaacccggggtaacgttcccccggtcgtaccgtcgacccgtagtttccgagggtcgggcgggcgggtcgtaggggactacggtactttcgactctcacatcagacacgtctcgcgacgctagaagtggtaggttcggtaccttagttttacgtacgtacgtaccgtaagtacctaaattaactttaacctaacccgttaacccggttcccggttaccgtaacccgggttttcgggggacccggggtaaccgggttaaccggttaaggggttaccgggtaagtaacgtaacggtaaacgggaacgttaaccggttgggttccgggtaaccg

SEQ ID NO: 334611 - DNA, 591 bp, Homo sapiens
  misc_feature: GZ8MTXP01BYVTN.25.38.D05.1.454.CMB.2.raw
  modified_base (330)..(330): a, c, t, g, unknown or other
  misc_feature (330)..(330): n is a, c, g, or t
  modified_base (562)..(562): a, c, t, g, unknown or other
  misc_feature (562)..(562): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtgggacatcgtgatcgacccagtcctccacgacctcccgtggctgtgtctcgtggggcgaggacgggccaccatacaactgacaagtccagcctagtagtttattttacactctaaccaacaagtaacgtacttctagtcttaggtactacagacaacggaaaccgaggcacgcctacagctgctntatcgtacgcggacctacgtaccggtactcccggtcgtccgacgaccgtattcgacgggtcggggccgggtcgggtcgtcgggactacgtactttccacttctaccacgtataccagtccgacgccgtgaccgaggctaaggaagtggtggtcgtattagtttatctgtactaactattaattacttactacctaacgtcgttacgtcggttcgggcggacggagttacggngaatagaacgacgagttacgtgcggtaac

SEQ ID NO: 334612 - DNA, 577 bp, Homo sapiens
  misc_feature: GZ8MTXP01A1A5B.25.38.D05.1.454.CMB.2.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggttgtccagtgtcaggtgcagctggtggagtcgtgggggagcgtggtccagcctgggaactccctgagactctcctgtgcaacntcnggatcgccttnagttacttggcatccacgtgggtcccncgaggcctaccgaggccaaaggggctaggaggttggggtntactttttagngggcagtgatgggacaagtcgaataaagcctatgacagacctcgtacgaacgggccctacttctccattccnccgaagacaacgaacgacccgaaagggtaacggtccggttacctttaggaacctaaagtaacgaaaacgccgtacgacggacccgaggaccaacggtcttagtcgttatacgtgcgcgagaacgcgtaagtggagagtgcgtaagg

SEQ ID NO: 334613 - DNA, 714 bp, Homo sapiens
  misc_feature: GZ8MTXP01AQ4TK.25.38.D05.1.454.CMB.2.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgacgactctcctgtgcaacntcgtggattcgccttnacgttaactttggcatcccgactcgggtcccnccgaggcctaccgaggacgaaaggggtctaggagttgggttgtactttttagtgggctagtgagtgggactaaggttagaaagtaaagcccttaagtcgactacgtaccgttcccgggtacgaaacggggtcccgttcctttaccgtaccctacttacctacccgaaacggaaccgaaccgaaaccggacccgaaaacggggtaacggttaacccgggtttaccttttacggaaactaaacgtaacggaaaaccgtaccgaacggtaaccgaacccggaacgggaaccgtaaccgggtacttaagttacggttaaacgtttaccgtgggttacggcgaacgggtaaccggaccgtaagggttacggaaagggttcgggttgggaacggttaacgggg

SEQ ID NO: 334614 - DNA, 602 bp, Homo sapiens
  misc_feature: GZ8MTXP01APCAU.25.38.D05.1.454.CMB.2.raw
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagacgggccaccatcaactgacaagtccagccagtagttatttttacagtctaccaaacaagtaaggtacttctaagtcttaggtatacagacaacggaaaccgagggacacgccctaccgtaagctagctacagttcggtaacgtcgggccgttaccgtacccggggactccccggtcgtcctagacccgtattcgacggtcgggccgggtcgggtcgtaggggactaggtactttacactctacaccatcagaccncgcngacgngnagaagtggtggtagtacttagtttactcgtgtacatactaattactactaccgtcgtcggttacgtacggttccgggacggtacggttaacggttagggttacgaagtacgtaacgaagaacgttcgtggttcgcg

SEQ ID NO: 334615 - DNA, 619 bp, Homo sapiens
  misc_feature: GZ8MTXP01BZN84.25.38.D05.1.454.CMB.2.raw
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
  modified_base (612)..(612): a, c, t, g, unknown or other
  misc_feature (612)..(612): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggtttttcctcgttgcttctttttaagaggtgtccagtgtcaggtgcagctggtggagtcgtgggggagcgtggtccagccgtgggaactccctgagactctctgtgcaacntcnggatcgcttcatacttggcatccactcggccncaggcctcgaggcaagggctaggagttggggntacttttagtgggactagtgacgttgggacaaggtanaaagttaaaacggcccttaagtcggacacgtacctccgtacgaacggggcctacttctaccacttcaccaagacgaaccaaacggaccaaaggggtaacggtaccggtttaccctttaggaacctaaagtaacgaaaacgtccccgtagaacggaacccgaggaccgtaacgggtacttaagtagttacgttaacgtgttacggcgaggaacgcccgtaaggtgaggaggtaaccgggngtaacgg

SEQ ID NO: 334616 - DNA, 632 bp, Homo sapiens
  misc_feature: GZ8MTXP01DUIVU.25.38.D05.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (573)..(573): a, c, t, g, unknown or other
  misc_feature (573)..(573): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggatccctgagactctctgtgcacatcnggattcgccttanagttactttggcatcccagtcgggtccnccgaggcctccgaggcaaagggctaggagttgggtntactttttagtgggctagtgagttgggactaaggtagaaacgttaaaagcccttaagtcggacgtaacggacccgttacccggtacgaaacgggggtcccttctttacctaccctacttcctacccgaaggaaccgaaccgaaaccgacccaaaggggtaacggtaccggtttacctttagacctaaaagtacgaaacgtaccgtagaccgacccggagaccgaacggtnttagtagttattacgtgttacgcgaagaacgacgtaaggtgaggaggtcggcgtaaggg

SEQ ID NO: 334617 - DNA, 727 bp, Homo sapiens
  misc_feature: GZ8MTXP01BOYQB.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatcgacccagtctccagacctccctggctgtgtctcgtgggcgaggacgggccaaccatacaactgacaagtccagccagtagtttatttttacagtcctaccgaaactaagtaacggtactttactacgtcgttaggttataccaagaccaaaggaaaacccgagggacctacggccccttacgtaaacgtccttacgacctacgtacgttggttaaccggttcggggtaccgttccggtaaaccccggggtaacgttccccccgggttacggttacccgtacggtaccccgtaagttccgaagggttccgggggaccgggtccgggggtttacgtggggtaacgtacggttaactttccgaccttctaaccacctagtccagggactacgtcccgtggacgaggtctagaaagtagtggtagacttagtttactacgtgtaacagccttaaattcttaactccgttaacttccggttactacccggtttcggggaccggcccgggttaaagttacgggttagggtaaccagttaaccggaaaggtaacggaacgttgggttaacggcg

SEQ ID NO: 334618 - DNA, 603 bp, Homo sapiens
  misc_feature: GZ8MTXP01DURJ3.25.38.D05.1.454.CMB.2.raw
  modified_base (322)..(322): a, c, t, g, unknown or other
  misc_feature (322)..(322): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgacccagtctccagactcccgtggctgtgtctcgtgggcgaggacgggccaccatcaactgacaacgtccagccaagtagttatttttacagtctaccaacaataaggacttctagcttaggtatcagacaagaaaccgagggacacgccctacaagctgctnatcgtacgtggctacgaccggtacgtccccggtgtccgtagacctagttccgaggtcgggcggtcgggtcgtgggaactagtacttcacgtctacaccatcagcacgcctgcagcagaagngtgtggtacttagttntacgtgtaccgagtactaattacttactccgttaacgttccggttacgttaccggtttcggggaccgggtaacgggttaaccggttagggttacggaacgtacgttaaccgaaggtaaaccgttaggttcggcgggttaacccg

SEQ ID NO: 334619 - DNA, 733 bp, Homo sapiens
  misc_feature: GZ8MTXP01AZR50.25.38.D05.1.454.CMB.2.raw
  modified_base (267)..(267): a, c, t, g, unknown or other
  misc_feature (267)..(267): n is a, c, g, or t
  modified_base (517)..(517): a, c, t, g, unknown or other
  misc_feature (517)..(517): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatcgacccagtctccagacctcccgtggctgtgtctcgtgggcgaggacgggaccaccatacaactgacaacgtccagcctagtagtttacttttacacgtctaccaaanaagttacggtacttctagtcgttaggtactcgaagacaaacggaaaccgacgggaccaacgtcccctaaccgtaacgtccgtcgtacctacgtaacgttacggtaccggtcggggtaccgttacccggtaccccggggtaacgttcccccgggtaccgtcccgtacgaccgtacgttcggacgggtcgggccgggtacgggtcgaggggacctaggtacttcccgactcgtacccacgtcaccgacgacncgtccgaggacgttagacgttaggaaagtggggtaggttacggtactttaagttttacgtcgttaccgtacaacggttaattaaacgtttaacgttaccttaaccgttaaccgtttccgggttaaacgttcccgggtttaccgggggaccggtaacggggaaccgttagggaccggtaagtaccgttaagacggtacgttacgtggttaaccgtcg

SEQ ID NO: 334620 - DNA, 975 bp, Homo sapiens
  misc_feature: GZ8MTXP01E00N4.25.38.D05.1.454.CMB.2.raw
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctgggtggagtcgtggggggagcgtggtccagccgtgggaacgtccctgacgtactcctccgtgtcgacaaacgattcgtggtactttcccggtccctttacgtaacggtttaaaccttttcgggcctaacgttcccccgacggtttccgggggtcccccgcccgaacggggtcccttaccccggaaggggacccgaaaaggggggtaccttaagggtagggttcggggggttacgtttaaccgtttttttaacggtcggggggactaaggttgggtaaacgttgggggaccgtaaggtttagaaacgttaaaaaaccggggtccctttaaaggtcggaccgtaacgggtaacccgttacccgggttacccggtaaaccgggggtccccgttcccgtttacccgttaccccgtaaccgtttaccccttaacccgaaacggaaacccggtaaacccgtaaaaccccgggaacccccggtaaaaacgggggtaaaccgggtttaacccggggttttaccccgttttttaacggaaacccgttaaaaaacggttaaaccgggaaaaaaccggtaccccggttaacggggtaaacccgggaaaccccccggggtaaacggggaaaccccgtaaaccggggttaacgtttaaacggtttacggttttaaacgtttaaacccggttgggttaccgggttacggttaacgggtaaccggacccggtaagggttaccgggaacgggttaggggttaaccggggaacggttaaccggggg

SEQ ID NO: 334621 - DNA, 672 bp, Homo sapiens
  misc_feature: GZ8MTXP01BVA8R.25.38.D05.1.454.CMB.2.raw
  modified_base (269)..(269): a, c, t, g, unknown or other
  misc_feature (269)..(269): n is a, c, g, or t
  modified_base (386)..(386): a, c, t, g, unknown or other
  misc_feature (386)..(386): n is a, c, g, or t
  modified_base (443)..(443): a, c, t, g, unknown or other
  misc_feature (443)..(443): n is a, c, g, or t
  modified_base (633)..(633): a, c, t, g, unknown or other
  misc_feature (633)..(633): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatcgacccagtcctccagactccctggctgtgtctcgtgggcgagacgggccaccatcaactgacaacgtccagccagtaagttatttttacagctacaacaagtagacttntagtcttggtatcagacaacgaaaccgaggaccacggccctactaagctcgctctatcgtacgtcggtaccgtaccgtaccccggggtaatcccccggtcgtacccgtggacccgtnttacgaggtcggggcgggtcgggtcgtacggggactacggtcttacgactcgtaccnccaatccgaagccaggtccctaggcgtacgacgtaggaaaggtcgttgggtagggtaccttaaggtttttaacgtaccgttgtaaccgtaaggtaaccttaatttaaactttaacgtaaccggttaaccgtttaccgggttacccgttacggtttcccggggaccgggtacgggttaaccgttaaggggngtaacgagtaacgacggtaacgacgttggttaacggtcc

SEQ ID NO: 334622 - DNA, 650 bp, Homo sapiens
  misc_feature: GZ8MTXP01EDHJ1.25.38.D05.1.454.CMB.2.raw
  modified_base (184)..(184): a, c, t, g, unknown or other
  misc_feature (184)..(184): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (335)..(335): a, c, t, g, unknown or other
  misc_feature (335)..(335): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggttttcctcgttgcttcttttaagnggtgtccagtgtcaggtgcagctggtggagtcgtgggggagcgtgtccagcctgggactcctgagactctcngtncaantcnggatcgcttnagtacttgcatccatggccncaggctcgagcaaggctagagtgggtatacgtttttagnggggctagtggtagttacgggactaaggttgaaactttaaaacggcccctttaagtcgaccgtaacgtacccgttaccggttaccggaaacggggtccctcgtttaccctacccgtacttacctacccgaagaaccgtaacccgaaaccggaccctaaaacgggggtaacggttaacccggtttaccttttacggaaactaaaaccggttagaaaacgtccgtaggaacgaccccggtaaggaccgaacggtacttagtacgttaattaccgtgttagcgttaagcgcgaagtggagacgtcggaacgtaacggg

SEQ ID NO: 334623 - DNA, 584 bp, Homo sapiens
  misc_feature: GZ8MTXP01C3DHI.25.38.D05.1.454.CMB.2.raw
  modified_base (181)..(181): a, c, t, g, unknown or other
  misc_feature (181)..(181): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctgttgcttcttttaagnggtgtccagtgtcaggtgcagctggtggagtcgtgggggagcgtggtccagcctgggaatccctgagactctcctgtnctacatcnggattcgcttacagttaacctttggcatccagtcggccnccaggcnccgaggcaagggctgagtggtnacttttangggacntcggattgggacnggtanagtaaacgcctaatgacagactccgtagaacgggctacttctcacgtcctacagagacaaacgccaaagggaacggtccggtttacttcgacaaacgtacgaaaggtcctagacggacccgtaggacgaaccgggtcttagtagttaacgttaacgtcggttaagccggttaaggaaccgtaccgaagggttcggagagggttcgaacgtaacgggg

SEQ ID NO: 334624 - DNA, 495 bp, Homo sapiens
  misc_feature: GZ8MTXP02I74R6.25.38.D05.1.454.CMB.2.raw
  modified_base (348)..(348): a, c, t, g, unknown or other
  misc_feature (348)..(348): n is a, c, g, or t
  modified_base (408)..(408): a, c, t, g, unknown or other
  misc_feature (408)..(408): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggtgacatcgtgatgacccagtctccagactccctggctgtgtctctgggcgagagggccaccatcaactgcaagtccagccagagtatttttacagctccaacaataaggacttcttagcttggtatcagcagaaaccagggcagcctctaagctgctcatgtactgggcgtctaccgggaatccggtgtccctgaccgattcngtggcggcggtctgggacagatttcactctcaccatcagcagcctgcaggctgaagatgnggcagtttatactgtcagcaatattatactactccggtcactttcggcggtcgggaccaagggtgaagactacagacgaacgtgtgg

SEQ ID NO: 334625 - DNA, 572 bp, Homo sapiens
  misc_feature: GZ8MTXP02GI7V8.25.38.D05.1.454.CMB.2.raw
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
tcagactgtacagtcacgaccggtgctcgatttagtatctgatagttgggtttgggagctctgggagaggagcccagcactagaagtcggcggtgtctccattcggtgatcagcactgaacacagaggactcaccatggagtttgggctgagcgtgggtttcctcgttgctctttaagaggtgtccagtgtcaggtgcagctggtggagtctgggggaggcgtggtccagcctgggaagtccctgagactctcctgtgcaacatctggattcgccttcagtaactttggcatccatggtccnccaggctccaggcaagggctagagtgggtgacttttatgggcatgatggngngtagataaagactatagcagactccgtacgaacggacgctctcctactctaccacgacgaacaaacgaaccgaaacgaaacgtacgttaccgtttacgtacgaaacgtaacgaaacgaacgtacgacgaaccgaacggaacgaacggtacgtagtacgtacttacgtacgtacgtacgacgaacgacgacggtacggaggacggtacggtacgtacgg

SEQ ID NO: 334626 - DNA, 519 bp, Homo sapiens
  misc_feature: GZ8MTXP02JNIKO.25.38.D05.1.454.CMB.2.raw
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgccttcagtaactttggcatccactgggtccnccaggctccaggcaagggctagagtgggtntacttttagtgggcatgatggcagtgaataaagcctatgcagactcgtcaaggccgcttctccactctaccagacgacaaacgaccaaagaacgacggttacctttagactaaatagaaaagcctagacgacccgagacacggctancgtatactgtgcgagaagcagngagagtcggacgng

SEQ ID NO: 334627 - DNA, 493 bp, Homo sapiens
  misc_feature: GZ8MTXP02ICOR0.25.38.D05.1.454.CMB.2.raw
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttcttagcttggtatcagcagaaaccaggcagcctctaagctgctcatgtactgggcgtctaacccgggaatccccggtgccctgaccgattcagtggcggcgggtctgggacagatttcactctcaccatcagcagcctgcaggctagaagatgtggctagttatactgtcagcaatatatactactcgtcactttcgcgtcggaccaagtgaagagtacagacgaacgtgtaggc

SEQ ID NO: 334628 - DNA, 495 bp, Homo sapiens
  misc_feature: GZ8MTXP02G8SCN.25.38.D05.1.454.CMB.2.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctggcgagagggccaccatcaactgcaagtccagccagagtatttttacagctcaacaataaggacttcttagcttggtatcagcagaaaccagggcagcctcctaagctgctcatgtactgggctctacccgggaatccccggtgtccctgaccgattcagtggcgcgggtctgggacagatttcactctcaccatcagcagcctgcaggctgaaagtntgtgntagtttatagtntnagacaatatatactactacgtctacgtcgtcggcggacgagagaagagacgacgaagacgtacgtgcg

SEQ ID NO: 334629 - DNA, 498 bp, Homo sapiens
  misc_feature: GZ8MTXP02IW7R7.25.38.D05.1.454.CMB.2.raw
  modified_base (460)..(460): a, c, t, g, unknown or other
  misc_feature (460)..(460): n is a, c, g, or t
  modified_base (483)..(483): a, c, t, g, unknown or other
  misc_feature (483)..(483): n is a, c, g, or t
  modified_base (490)..(498): a, c, t, g, unknown or other
  misc_feature (490)..(498): n is a, c, g, or t
tcagactgtacagtcacgaccggtgctcgatttagtatctgatagttgggtttggtggtctccactcccgcccagtctgtgctgtctcagccaccctcagtgtctggggcccccgggcagagggtcgacatctcttgttctggaagtcgctccaacgtcggcagtaatagtgtaagctggtaccagcaactcccaggaaccggcccccacactcctcatgtatgggaatgatcagcgcccctcaggggtcccctgacccgattctctgccctccacgtctggcacctcagccctcccctggcccatccgtggctccaatctgaggatggaggccgattattattgtgcagcgtgggatgacaggaagacgggttatgtcttcgattggggacaggtcacgtctagcagcccaaggcccaacccactgtcactctcgttccccgccctcctcactcgtacngtctgagcgggctggacaaggcncgatagnnnnnnnnn

SEQ ID NO: 334630 - DNA, 523 bp, Homo sapiens
  misc_feature: GZ8MTXP02I8RIT.25.38.D05.1.454.CMB.2.raw
  modified_base (441)..(441): a, c, t, g, unknown or other
  misc_feature (441)..(441): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctcaacaataaggacttctagcttggtatcagcagaaaccaggcagcctcctaagctgctcatgtactggcgtctaccgggatccccggtgtccctgaccgattcagtcgggcggcgggtctgggacagtatttcactctcaccatcagcagcctgcaggctagaagatgtggctaggtttatactgtcagctaatattanactacgttccggtactacgtttcgggcggtcgggaacccaagggtggaagtacgtacgaaggaccgtaaacgtggtaggccg

SEQ ID NO: 334631 - DNA, 504 bp, Homo sapiens
  misc_feature: GZ8MTXP02ILSIY.25.38.D05.1.454.CMB.2.raw
  modified_base (243)..(243): a, c, t, g, unknown or other
  misc_feature (243)..(243): n is a, c, g, or t
  modified_base (426)..(426): a, c, t, g, unknown or other
  misc_feature (426)..(426): n is a, c, g, or t
  modified_base (494)..(504): a, c, t, g, unknown or other
  misc_feature (494)..(504): n is a, c, g, or t
tcagactgtacagtcacgaccggtgctcgatttagtatctgatagttgggtttggtggtctccactcccgcccagtctgtgctgtctcagccaccctcagtgtctggggcccccgggcagagggtcgacatctcttgttctggaagtcgctccaacgtcggcagtaatagtgtaagctggtaccagcaactcccaggaaccggcccccacactcctcatgtatgggaatgatcagcgcccctnaggggtcccctgaccgattctctgcctccacgtctggcacctcagcctcccctggccatccgtggctccatctgaggatgaggccgattattatgtgcagcgtgggatgacaggaagacggttatgtcttacggaattggggaccaaggtcaccgtcctaggtcagcccaaggccccaacccntcgtcactctcgttccccacccttcctcactcgtacagtctgacgcgggctggccaagggcacatagnnnnnnnnnnn

SEQ ID NO: 334632 - DNA, 503 bp, Homo sapiens
  misc_feature: GZ8MTXP02JWQWA.25.38.D05.1.454.CMB.2.raw
  modified_base (410)..(410): a, c, t, g, unknown or other
  misc_feature (410)..(410): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttcttagcttggtatcagcagaaaccagggcagcctctaagctgctcatgtactgggctctacccgggatccccggtgtcctgaccgattcagtggcggcgggtctggggacagatttcactctcaccatcagcagcctgcagctagagatgnggctagtttatactgtcagcaatatatactactcggtctactttcgggcggtcggaccgtaaggtggaagacgtacgagaagtactggtcgcg

SEQ ID NO: 334633 - DNA, 508 bp, Homo sapiens
  misc_feature: GZ8MTXP02IGP4V.25.38.D05.1.454.CMB.2.raw
  modified_base (379)..(379): a, c, t, g, unknown or other
  misc_feature (379)..(379): n is a, c, g, or t
  modified_base (431)..(431): a, c, t, g, unknown or other
  misc_feature (431)..(431): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctcaacaataagacttctagcttggtatcagcagaaaccagggcagcctctaagctgctcatgtactgggctctacccgggatccccggtgtccctgaccgattcgagtgggcggcgggtctgggacagatttcactntcacatcagcagcctgcaggctgaagatgtggctagtttatactgtacaganaattatatactaactccggttctacgtttcgggacggtcgggacctaaggtgaagtactacgagaagacttggcgcg

SEQ ID NO: 334634 - DNA, 552 bp, Homo sapiens
  misc_feature: GZ8MTXP02JDUBI.25.38.D05.1.454.CMB.2.raw
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (467)..(467): a, c, t, g, unknown or other
  misc_feature (467)..(467): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctcaacaataaggacttcttagcttggtatcagcaagaaaccgaggcagccctacctaagctgctcatgtacgtgggccgtccgtaacccggggaactccccggtcgtccctcgacccgtattccgaggttcggggccgggtcggggtcgtaggggacaggtactttcgactcacaccatcagcagccctgccaggctagaanagtgnggtctagtttactacgngtacagtacaattaatactacctactccggtctacgttcggcgggacggacctaggtcgaagatacgagtaagacttggactacg

SEQ ID NO: 334635 - DNA, 498 bp, Homo sapiens
  misc_feature: GZ8MTXP02JWD97.25.38.D05.1.454.CMB.2.raw
  modified_base (472)..(472): a, c, t, g, unknown or other
  misc_feature (472)..(472): n is a, c, g, or t
  modified_base (489)..(498): a, c, t, g, unknown or other
  misc_feature (489)..(498): n is a, c, g, or t
tcagactgtacagtcacgaccggtgctcgatttagtatctgatagttgggtttggtggtctccactcccgcccagtctgtgctgtctcagccaccctcagtgtctggggcccccgggcagagggtcgacatctcttgttctggaagtcgctccaacgtcggcagtaatagtgtaagctggtaccagcaactcccaggaacgcccccacactcctcatgtatgggaatgatcagcgcccctcaggggtccctgaccgattctctgcctccacgtctggcacctcagcctcctggccatccgtgggctccaatctgaggatgaggccgattattattgtgcagcgtggatgacaggaagacgggttatgtcttacggaattggggaccaaggtcaccgtcaggtcagcccaaggcccaaaccccgactgtcactctcgttcccgccctctcactgtaccagtctggacgcgggntcggacacggcgcatgnnnnnnnnnn

SEQ ID NO: 334636 - DNA, 499 bp, Homo sapiens
  misc_feature: GZ8MTXP02JC5N1.25.38.D05.1.454.CMB.2.raw
  modified_base (408)..(408): a, c, t, g, unknown or other
  misc_feature (408)..(408): n is a, c, g, or t
tcagactgtacagtcacgaccggtgctcgatttagtatctgatagttgggtttggggagctacaacaggcaggcagggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctcaacaataaggacttctagcttggtatcagcagaaaccagggcagcctctaagctgctcatgtactgggcgtctacccgggatccccggtgtccctgaccgattcgagtggcggcgggtctgggacagtatttcactctcaccatcagcagcctgcaggctgaaagntgtgctagtttatactgtcagcaattattatactactcggtctacgttcggcggtcggaccaaggtgaacgtatcagacgaactggcggtc

SEQ ID NO: 334637 - DNA, 508 bp, Homo sapiens
  misc_feature: GZ8MTXP02FRH4Z.25.38.D05.1.454.CMB.2.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (361)..(361): a, c, t, g, unknown or other
  misc_feature (361)..(361): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaagtccctgagactctcctgtgcaacatcnggattcgccttcagtaactttggcatccatgggtccncaggctccaggcaaggggactagagtggggtgacttttagtggggcagtgatggcngtgataaagcctaatgcagactcgtcagggccncttcncatctccagagacaaacgccaaagacgacggtcctttagacaaatgaaagcctagacgaccgagacacggctatgtatactgtagcgagaagcagtgagagtggcgagg

SEQ ID NO: 334638 - DNA, 680 bp, Homo sapiens
  misc_feature: GZ8MTXP02G1O9S.25.38.D05.1.454.CMB.2.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaatccctgagactctcctgtgcaacntctggattcgccttcagttactttggcatcccacgtcgggtccnccaggcctccgagggcaaaggggactaggaggtggggtagttacttttagtggggctagtggatgggcagggttagaaattaaaacggcccttaagtcgaccgtaaggtaacccgttcccgtacgaaacggggtcccgtcctttaccctcccgtatcccttacccgaagaacgaaccgaaaaccgacccgaaaaggtaaacggtaaccgggtttacctttttacggaacctaaaagtaaggaaaaacgccgtaacggaacggaaccccggaaggaacccgaacgggtacttaagttacgttaagttaaccgttggtacggacggaacggaacgaccgaaggtacggaaggtaacggtcgggacgtacgggg

SEQ ID NO: 334639 - DNA, 520 bp, Homo sapiens
  misc_feature: GZ8MTXP02IWSLM.25.38.D05.1.454.CMB.2.raw
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
tcagactgtacagtcacgaccggtgctcgatttagtatctgatagttgggtttggggaggtctcagagaggagccttagccctggactccaaggcctttccacctggtgatcagtactgagcacagaggactcaccatggaattggggctgagctgggttctccttgttgctattttagaaggtgtccagtgtgaggtgcagttggaggagtctgggggaggcttggtccaggccggggggtccctgagactctcctgtgcagcctctggattcagttttagcagattttggatgagctgggtccgccaggccccagggaaggggctgggtgtgggtagccaacatacacgaagatggaggtgagaaatactatgcggactctgtgaagggccgattcacatcncagggacaactccaaacactcagtatatcngacaaatgaatggtctggagagccgaggacacggctgtgtatttcgngtgcgagngtcgcccgaatccgatacgaccctatcgttc

SEQ ID NO: 334640 - DNA, 512 bp, Homo sapiens
  misc_feature: GZ8MTXP02HZ67O.25.38.D05.1.454.CMB.2.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (478)..(478): a, c, t, g, unknown or other
  misc_feature (478)..(478): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgccttcagtaactttggcatccactggtccnccaggctccaggcaagggctagagtggngtacttttagtgggcatgatggcngtgaataaagcctatgcagctcgtcgaagggccgcttctccatctccagagacaacgaccaaagaacgtaacgttcctttagactaaatacgaaaagctagacgaccgagacacggctatntatactgtgacgagaagcagtgagagtggacagg

SEQ ID NO: 334641 - DNA, 537 bp, Homo sapiens
  misc_feature: GZ8MTXP02GGF5S.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaacaataaggacttctaagcttggtatcagcaagaaaccagggcagcctccaagctgctcatgtactgggcgtcgtacccgggatccccggtcgtccctgaccgtattcagtcgggcggcgggtcgtgggacagtacttcgactctacacatcagcacgcctgcaggtcagaagtatgtgctagtttatacgtgtacagactaaattattactaacttacgtccggtactacggtttcggacggtcgggaacctagggtgaagtacgacgaggaagtaacgtggtcgacg

SEQ ID NO: 334642 - DNA, 594 bp, Homo sapiens
  misc_feature: GZ8MTXP02JQQ2O.25.38.D05.1.454.CMB.2.raw
  modified_base (306)..(306): a, c, t, g, unknown or other
  misc_feature (306)..(306): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtgggttttcctcgttggctctttaagaggtgtccagtgtcaggtgcagctggtggagtctgggggaggcgtggtccagcctgggaagtccctgagactctcctgtgcaacatctggattcgccttcagtacttggcatccactgggtcccncgaggctcgaggcgaagggactaggaggtggtgtacttttagtgggctagtgagtggctaggtagaaagtaaacgcctatcgacacgaccgtaccgtacgaacgggccgtccttctacctactcctaccacgacgaaccaaccgaccgaaacgaacgtaccggttactttacgaactaaagtaagaaacgccgtacggaaccgaccggacggaaccgacggactagtacgttattacgtcgtacgacgagaacgacgtaaggtacggaggtacggtacggacgtacgg

SEQ ID NO: 334643 - DNA, 562 bp, Homo sapiens
  misc_feature: GZ8MTXP02JT0FC.25.38.D05.1.454.CMB.2.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (423)..(423): a, c, t, g, unknown or other
  misc_feature (423)..(423): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaacgtccctgagactctcctgtgcaacntctggattcgccttcagttaactttggcatcccacgtcgggtcccnccaggcctccgaggccgaaaggggactaggaggtggggtatacgtttttagtgggcagtgatgggcaggtgaataaagcctatgcagactccgcgaacgggcctcttccncatcctaccgagacgacaaccgcaaaggacgtacggttctttagacaaagtagaaacgcgtagacgaccgaggacacggtactagtgttacttacgtgtcgacgagaacgcgtaggtacgaggacggtggacgtacggg

SEQ ID NO: 334644 - DNA, 527 bp, Homo sapiens
  misc_feature: GZ8MTXP02IR8E4.25.38.D05.1.454.CMB.2.raw
  modified_base (420)..(420): a, c, t, g, unknown or other
  misc_feature (420)..(420): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaaacaataaggacttctagcttggtatcagcagaaaccagggcagcctacctaagctgctcatgtactgggcgtccgtaccgggatccccggtcgtccctgaccgattcgagtgggcggcgggtcgtgggacagtacttcactctacacatcagcagcctgcagctagagatggngctagtttatacgtgtcagctaatattactacttacgtccggtactacggtttcgggcggtacgggtaaccaggggtgaagacgtcgagaccgtaacgtgtaggccg

SEQ ID NO: 334645 - DNA, 508 bp, Homo sapiens
  misc_feature: GZ8MTXP02JUGY8.25.38.D05.1.454.CMB.2.raw
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (499)..(508): a, c, t, g, unknown or other
  misc_feature (499)..(508): n is a, c, g, or t
tcagactgtacagtcacgaccggtgctcgatttagtatctgatagttgggtttggtggtctccactcccgcccagtctgtgctgtctcagccaccctcagtgtctggggcccccgggcagagggtcgacatctcttgttctggaagtcgctccaacgtcggcagtaatagtgtaagctggtaccagcaactcccaggaaccggcccccacactcctcatgtatgggaatgatcagccgcccctgaggggtccctgacccgattctctgccctccacgtctggcacctcacgccctccctggccatccggtggcctccaatctgaggatgaggccgtattattatgtgcagcgtgggatgacaggaagacggttatgtcttacggaattcgggacaaggtcaccgtcctaggtcagcccaaggccccaaccctactgtccactcctcgttccccgccctcctcacgtntacacgttcngcgcggcnggacacggcnacannnnnnnnnn

SEQ ID NO: 334646 - DNA, 527 bp, Homo sapiens
  misc_feature: GZ8MTXP02I5HYM.25.38.D05.1.454.CMB.2.raw
  modified_base (428)..(428): a, c, t, g, unknown or other
  misc_feature (428)..(428): n is a, c, g, or t
  modified_base (472)..(472): a, c, t, g, unknown or other
  misc_feature (472)..(472): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctccaaacaataaggacttcttagcttggtatcagcaagaaaccagggcagccctctaagctgctcatgtactgggccgtcgtaaccccggggaatccccggtcgtccctgaccgattcgagtcgggcggcgggtctggggacagtactttcactctcaccatcaagcagcctgcagctagaaagntggtgctagtttaatctgtcagacaattatagtactctccggtntaccgttcggcggacgggaaccaggtggaagactacgaaagaagaactggtacgc

SEQ ID NO: 334647 - DNA, 523 bp, Homo sapiens
  misc_feature: GZ8MTXP02IW7NX.25.38.D05.1.454.CMB.2.raw
  modified_base (415)..(415): a, c, t, g, unknown or other
  misc_feature (415)..(415): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctccaacaataaggacttcttagcttggtatcagcagaaaccagggcagcctcctaagctgctcatgtactgggcgtcgtaccgggatccccggtcgtccctgaccgattcagtgggcggcgggtcgtgggacagtatttcactctcaccatcagcacgctgcagctagaagntgtgactagtttatactgtacagactaattattatacttactccggtctacgtttcggacggtcgggaaccgaagggtgaagacgtacgaagaagaacttggcgtacg

SEQ ID NO: 334648 - DNA, 540 bp, Homo sapiens
  misc_feature: GZ8MTXP02GQ69Q.25.38.D05.1.454.CMB.2.raw
  modified_base (310)..(310): a, c, t, g, unknown or other
  misc_feature (310)..(310): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattccgccttcagttaactttggcatccacgtgggtcccnccaggcctccgaggccaaaggggactaggaggtgggtagtacttttagtggggctagtgatggcagtgaataaagcctatgacagactccgtacgaacgggccgcttctccactctccagacacaacgaccaaagaacgacgtctttagacaaatagaaagcagacgaccgagacgacgactatagtattactgtacgagagaagacgaggtacgagaggtggacgtagg

SEQ ID NO: 334649 - DNA, 536 bp, Homo sapiens
  misc_feature: GZ8MTXP02GV78G.25.38.D05.1.454.CMB.2.raw
  modified_base (486)..(486): a, c, t, g, unknown or other
  misc_feature (486)..(486): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccggggggtccctgagactctcctgtgcagcctctggattcagtttagcagtattttggatgagctgggtccgccaggcccccaggggaacggggctggtgtgggtagccaaacatacacgaagatggagtagaagaaatactatgacggactcgtgtagaaagggcccgattcaccatctcagggacaacgtaccaacaactcagtactatctagacaaatgaatggtactagagagccgaggacacggcngtgttacttctgtgcgagacgtcgaccccgaactccatacgacctattcg

SEQ ID NO: 334650 - DNA, 511 bp, Homo sapiens
  misc_feature: GZ8MTXP02IXVMD.25.38.D05.1.454.CMB.2.raw
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaaacaataaggacttcttagcttggtatcagcaagaaacccagggcagcctacctaagcctgctcatgtactgggcgtctaaccggatccccggtnccctgaccgattccgagtgggcgcggggtctgggacagtatttcacttncaccatcagcagctgcagnagagagtgtgcgtattattattntananatatatatactactacgtctacgtcggtcggacggacgaacggagaagagacgacgaagacgtacgtacgcg

SEQ ID NO: 334651 - DNA, 512 bp, Homo sapiens
  misc_feature: GZ8MTXP02GTCX6.25.38.D05.1.454.CMB.2.raw
  modified_base (498)..(498): a, c, t, g, unknown or other
  misc_feature (498)..(498): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttctagcttggtatcagcagaaaccagggcagcctctaagctgctcatgtactgggcgtctacccggggatccccggtcgtccctgaccgattcgagtgggcggcgggtcgtgggacaggtatttcgactctcaccatcagcacgcctgcagctagagatggtgctagttatactgtcagactaatatatacttactcgtctacgtttcggacggtcggaccgtaaggtggaagagtcganacgaactcgtgacg

SEQ ID NO: 334652 - DNA, 668 bp, Homo sapiens
  misc_feature: GZ8MTXP02GZV40.25.38.D05.1.454.CMB.2.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaatccctgagactctcctgtgcaaactntctgctcgcttnagttacttgcatccacgtcggccncgaggctccgaggacgaaaggactaggaggtgggtattacttttagtgggactagtggagtggactaggtagaaataaacgtcctaagtcgacaacgtaccgtacccggtacgaaccggggtcccgtcttccctaccctacttccgtaccgaacggaacgaaccgaaaccgaaccgaaaacggtaaacggttaaccggtttaccgtttacggaaactaaaacgtaacggaaaaccggtaccgtaacggaaaccggaaccccggtaacgggaacccgtaaccggtacttaacgttacgttaacttaacggtacgtacggacggaagaacggaccgtaaggtacggaaggtacggtcggacggtaggg

SEQ ID NO: 334653 - DNA, 525 bp, Homo sapiens
  misc_feature: GZ8MTXP02I9SE9.25.38.D05.1.454.CMB.2.raw
  modified_base (400)..(400): a, c, t, g, unknown or other
  misc_feature (400)..(400): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctggcgagagggccaccatcaactgcaagtccagccagagtatttttacagctcaacaataaggacttctagcttggtatcagcagaaaccagggcagcctcaagctgctcatgtactggcgtctaccggatccccggtgtccctgacccgattcagtggcggtcggtacgtgggacagatttcactctacaccatcagcagcctgcacggntagagtatggtagcttagtttatacgtgtacagactaattattactacgtacgtccgtactaccggttcggacggacgggaacgagggtacggaagtacgtacgaagaacgtacgtcggtacgcg

SEQ ID NO: 334654 - DNA, 634 bp, Homo sapiens
  misc_feature: GZ8MTXP02GKFL0.25.38.D05.1.454.CMB.2.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (377)..(377): a, c, t, g, unknown or other
  misc_feature (377)..(377): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcggtgtttcgcgtaggctctttaagaggtgtccagtgtcaggtgcagngtggtggagtgtggggnggcgtggtcgacgcgtggacgtccgtgagactctctgtgacacatntgtntcgtcctctagtacttgtcactccacgtcggtccgccgacggctccgaggacgaacggacgtaggtaggtgggtagttacgtttacgttggtcgtagtgtagtggtcgngtagtaaagtaaagtactagtcgacgacgtaccgtaccgtacggaacggtccgtccttcctacctactacctaccgaacgaacgaaccgaaaccgaaccgaaacggaaacggtaccgtttaccgtttacgtaacgtaaacgtaaacgaaaacgaccgtacgaaccggaaccggaacgaacgacggtacgtaagttacgttagttacgtacgtacgacgaacgaacgacgacggtaggaggtaggtacggacgtacgg

SEQ ID NO: 334655 - DNA, 529 bp, Homo sapiens
  misc_feature: GZ8MTXP02JFIVW.25.38.D05.1.454.CMB.2.raw
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctccaacaataaggacttctagcttggtatcagcagaaaccagggcagcctcctaagctgctcatgtactggcgtctacccgggaatccccggtgtccctgaccgattcagtgggcggcgggtctggggacagtactttcactctcaccatcagcagcctgccaggctagaagtagtggtggacttaggtttattaccgtgtacagctaattatatactactcggtactacgtttcgggcggaccgggacctaagggtggaagtagtaccgaggaagaacgttggaggc

SEQ ID NO: 334656 - DNA, 510 bp, Homo sapiens
  misc_feature: GZ8MTXP02HU8CI.25.38.D05.1.454.CMB.2.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctgggtggagtcgtgggggagcgtggtccagcctgggaatccctgagctctcctgngcaacatctggattcgcctnagtaacttggcatccacgtggtccnccaggcctcgaggcaaagggctagagtggtntacttttagtgggcagtgatcggnagtgaataaagccttaagngacagactcgacgacggccgctcncatcacagacaacaacgacaaagagtacgttcttagacaaanagaaacncagacgaccgagacacgntanagtactacgtgcgacgagaacgcgagngagngcgcgng

SEQ ID NO: 334657 - DNA, 541 bp, Homo sapiens
  misc_feature: GZ8MTXP02I4YBE.25.38.D05.1.454.CMB.2.raw
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaagtccctgagactctcctgtgcaacatctggattcgccttcagtaactttggcatccatggtccnccaggctccaggcaaggggctagagtggtagtacttttagtgggcatgatggcngtgataaagcctatgcagacncgtcaagggccgcttctcatctccagacgacaaacgcccaaagaacggtacggttacccttttagaccaaaataggaaaacgtcccgtagacggaacccgaggaacctacgggactataggttaattacgtgtagcgaagcgccagtgagacggtgcgagg

SEQ ID NO: 334658 - DNA, 512 bp, Homo sapiens
  misc_feature: GZ8MTXP02FUK98.25.38.D05.1.454.CMB.2.raw
  modified_base (354)..(354): a, c, t, g, unknown or other
  misc_feature (354)..(354): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtattttttacagtctaccaacaataaggacttcttagcttggtatcagcaagaaaccagggcagccctcctaagctgctcatgtacgtgggcgtcgtaccgggatccccggtgtccctgaccgnttccagtcggcggcgggtctgggacagtactttcactctcaccatcagcagcctgcaggctagaagntcgngctagtttatacngtacagactaattatatactactccggtntacgttcggcggcggacaggtgaagactacagtacgactgacgtc

SEQ ID NO: 334659 - DNA, 602 bp, Homo sapiens
  misc_feature: GZ8MTXP02JSZIE.25.38.D05.1.454.CMB.2.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaactccctgagactctcctgtgcaacntctggacttcgccttcagttaactttggcatccacgtcgggtccnccaggctccgaggcgaaggggctaggagtgggtagtacttttagtggggctagtgatgggctagggtagaataaaacggcctatcggactagaccgtaccgtacgaacgggccgtacttcctacctactctaccgacgacgaaccaaaccgaccgaaaggaacggtaccggttacctttacggactaaaacgtagaaaacgccgtaggacgaacccggaagacgacgggactagtacgtattaccgtgtacgacgagaacgcgtaggtacgaggaggtacggacgtacggg

SEQ ID NO: 334660 - DNA, 550 bp, Homo sapiens
  misc_feature: GZ8MTXP02GA1EL.25.38.D05.1.454.CMB.2.raw
  modified_base (450)..(450): a, c, t, g, unknown or other
  misc_feature (450)..(450): n is a, c, g, or t
  modified_base (546)..(546): a, c, t, g, unknown or other
  misc_feature (546)..(546): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagttatttttacagctaccaaacaataaggacttctagcttggtatcagcagaaaccagggcagcctcctaagctgctcatgtacgtgggccgtccgtacccgggatccccggtcgtccctgaccgtattcgaggtcgggcgggcgggtcgtgggactagtactttcactctaccaccatcagcacgtcctgcaggctagaagatgagtctagtttatacngtcagtacaattacttatacctacgttcccggtcttacggtttcgggaccggtcgggaaccgaagggtggaagtagaccgaaggaccgaattcggngtac

SEQ ID NO: 334661 - DNA, 489 bp, Homo sapiens
  misc_feature: GZ8MTXP02HRZRS.25.38.D05.1.454.CMB.2.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagactgtacagtcacgaccggtgctcgatttagtatctgatagttgggtttgggggagctacaacaggcaggcagaggcagcaagatggtgttgcagacccaggtcctcatttctctgttgctctggatctctggtgcctatggggacatcgtgatgacccagtctccagactccctggctgtgtctctggcgagaggccaccatcaactgcaagtccagccagagtattttacagctcaacaataagacttctagcttggtatnagcagaaaccaggcagccnctaagctgctcatgtacnggctctaccggatccgtncctgaccgnttcgngtggcgcggtctgggacagattcactctcacctancagcacgcncgcgacgacgagagagtgtgtacgtagttactatntacanatatatatactactacgtacgtacgtacgtcgacggacgagtaagagacgtacgagacgacgtacgtcg

SEQ ID NO: 334662 - DNA, 546 bp, Homo sapiens
  misc_feature: GZ8MTXP02HB2R6.25.38.D05.1.454.CMB.2.raw
  modified_base (311)..(311): a, c, t, g, unknown or other
  misc_feature (311)..(311): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgccttcagttaactttggcatcccactcggggtcccnccaggcctccgagggccaaaggggactaggaggttggggtgtacttttagtggggcagtgatggcagtgaataaagcctatgcagactcgtacgaagggccgcttctccatctccagacgaaccaacgaccaaagaacgtaccgttcctttagacaaagtagaaagcctagacgaccgagacgacggactatcgtatacgtgtacgcgagaacgcgagtcgagacggtgcgtagg

SEQ ID NO: 334663 - DNA, 512 bp, Homo sapiens
  misc_feature: GZ8MTXP02IVAOB.25.38.D05.1.454.CMB.2.raw
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggatccctgagactctcctgtgcaacatctggattcgccttcagtactttggcatccacgtgggtccnccaggctccgaggcaaggggactaggagtgggtntacttttagtgggcatgatggcnggtnataaagcctatgcagactcgtcaagggccgcttctccatctccaganacaacgccaaagacgtacgtcctttgacaaagtgaaaagctagacgaccgagacacggctatgtattactgtgacgagaacgcagtagagagtggcgtag

SEQ ID NO: 334664 - DNA, 578 bp, Homo sapiens
  misc_feature: GZ8MTXP02IXYH3.25.38.D05.1.454.CMB.2.raw
  modified_base (353)..(353): a, c, t, g, unknown or other
  misc_feature (353)..(353): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccgaggccgggggggtccctgagactctcctgtgcagcctcgtggattctagtttagctagtattttggatgagcgtgggtccgccacggccccgaggggagggcgtgggtgtgggtagccaanatacgacgaagatgggaggtagaagaaattactagtggacggtactcgtaggtaggaacgggccgtattccgaccactccgtaccgaacgggaacaacctaccaaacaactacaagtatactctagacaatcgaaagtgtactgagacgccgaggacacggctggtgttacttcgtggtcgacggagtacgtccgaccccgaataccataccgaacccttagtcg

SEQ ID NO: 334665 - DNA, 661 bp, Homo sapiens
  misc_feature: GZ8MTXP02F5OIT.25.38.D05.1.454.CMB.2.raw
  modified_base (267)..(267): a, c, t, g, unknown or other
  misc_feature (267)..(267): n is a, c, g, or t
  modified_base (377)..(377): a, c, t, g, unknown or other
  misc_feature (377)..(377): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtgggtttcctcgttaggctctttaagaggtgtccagtgtcaggtgcagctggtggagtctgggggaggcgtggtccagcctgggaagtccctgagactctcctgtgcaaacntctgatcgccttacagttacttggcatccacgtcgggtcccgcaggcctccgaggacgaagggtactaggaggtgggtagtacgttttagtgggctagtgacgtggacgngtagaataaacgtactatagacacgacgtaccgtacgacgggccgtccttcctacctactactaccacgaacgaacgaaaccgaaccgaaacgaaacggtaccggttaccgtttacgtaacgtaaaacgtaaacgaaaacgaaccgtacggaaccggaacccgggaacgggaaccggtaaccggtacgtaacgttaacgttaaacgtttaacgttacggtacggtacggaacggaacggaccgtaacggtacggtaagggtacgggtacgggtacggtaacggg

SEQ ID NO: 334666 - DNA, 555 bp, Homo sapiens
  misc_feature: GZ8MTXP02JOEM1.25.38.D05.1.454.CMB.2.raw
  modified_base (310)..(310): a, c, t, g, unknown or other
  misc_feature (310)..(310): n is a, c, g, or t
tcagactgtacagtcacgaccggtgctcgatttagtatctgatagttgggtttggggaggtctcagagaggagccttagccctggactccaaggcctttccacctggtgatcagtactgagcacagaggactcaccatggaattggggctgagctgggttctccttgttgctattttagaaggtgtccagtgtgaggtgcagttggaggagtctgggggaggcttgggtccaggccgggggggtccctggagactctcctgtgcagcctctggattcagttttagcagtattttggatgagctgggtccncaggccccagggaggggctggtgtgggtagccaacatacgacgaagatgggaggtgaagaaatacgtatgcggatcgtgtgaaggccgattcgaccatctccaggacaactccaaacaactcagtactatctgacaatagaatgtactggaagagccgaggaccacggacttggtgttattcgtggtgtacggagtacgtaccggcccgtaaagtcccgtacgtacgacccctagtcggtttacg

SEQ ID NO: 334667 - DNA, 596 bp, Homo sapiens
  misc_feature: GZ8MTXP02GWRCF.25.38.D05.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaagtccctgagactctcctgtgcaacntctggattcgccttnagttaactttggctatccacgtcgggtcccncaggctccgaggccaaagggctaggagtgggtntacttttagtgggctagtgagtggcaggtanaataaacgcctagtcgacagaccgtccgtacgaacgggccgtcttctccctactcctaccgaagacgaaccaaacggaccaaaaggaacggtacggttaccctttagaactaaaagtacgtaaaacgccgtaaggacgaacccggaggaaccacggacttataggttaacttacgtgtacgacgagaacgaccgaggtaggaggtacggcggacgtacgg

SEQ ID NO: 334668 - DNA, 509 bp, Homo sapiens
  misc_feature: GZ8MTXP02IP7S8.25.38.D05.1.454.CMB.2.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (399)..(399): a, c, t, g, unknown or other
  misc_feature (399)..(399): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgcccttnagtactttggcatccactgggtccnccaggctccgaggcaagggactggagtgggtntactttagtgggcatgatggcagtgataaagctatgcagactccgtcaacgggccgcttcnccatctccagacgacaacgccaagacgtacgctttagacaatgaaagcagagaccgaggacacggctatagtacttactgtcgcgagaagcgagtagagagtggacgagg

SEQ ID NO: 334669 - DNA, 560 bp, Homo sapiens
  misc_feature: GZ8MTXP02IOMXE.25.38.D05.1.454.CMB.2.raw
  modified_base (242)..(242): a, c, t, g, unknown or other
  misc_feature (242)..(242): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagactgtacagtcacgaccggtgctcgatttagtatctgataggttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacngtctccaaacaataaggacttctagtcttggtactcacgcaagaaacccagggcagcctcctaagctagctcaatgtactcggggacgtcgtaccgggaactccccgggtgtcccgnggtacccgattccgaggtcggggccgggcgggtctggggganacggtaatttccgactcctcacnctacagcagcctgngagctagagatcggtgctaggtttaatcgtagtcagactaaatatactactacgtcgtactacgtttcggcggacggaccgaaggtggaagaccgtagaacgaccgtaaacggcgtacgtcg

SEQ ID NO: 334670 - DNA, 554 bp, Homo sapiens
  misc_feature: GZ8MTXP02JEZVC.25.38.D05.1.454.CMB.2.raw
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaagtccctgagactctcctgtgcaacntctggatcgccttcagttaacttggcatccacgtgggtccncaggctccgaggcaagggctaggagtgggtntacttttagtgggcagtgatggcaggtgaataaagcctaatgacaagacctccgtacgaacgggccgtcttcctccactcctaccagacgaaccaaaccgaccaaagaacgtaccggttacctttagaacaaatagaaaagccgtagaacgaccgaggacacggactatcgtattacgtgtgacgagaagaccgagtacgagaggtcggcgtagg

SEQ ID NO: 334671 - DNA, 633 bp, Homo sapiens
  misc_feature: GZ8MTXP02JE826.25.38.D05.1.454.CMB.2.raw
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccggggggtccctgagactctcctgtgcagcctctggattctagttttagctagtattttggatgagcgtgggtccgccgaggccccgaggggaggggctgggtgtgggtagccaaacatacacgaagatagggaggtagaagaaatactagtcggacggtactcgtaggtaggaaacgggccgtattaccgacctactcctaccgacggggaacaacctacccaaactaaactacaagtaactatactagactaaaatgaaagtcggtataggagacggaccggaaggaccgaacgggtcgttaggttagttaacgtttcgttacggtggtaccggaggaagggtaagggtacgggaacggtaaaaaccgtgggtacgttaccggtaacgggtaaggg

SEQ ID NO: 334672 - DNA, 533 bp, Homo sapiens
  misc_feature: GZ8MTXP02FLR3P.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagtatttttacagctaccaacaataaggacttctagtcttggtatcagcaagaaaccagggcagcctcctaagctgctcatgtactgggcgtctacccggggatcccccgggtgtcccctgaccgtattcgagtgggcgggcggggtcgtaggggactagtatttccactcctaccaccatcagcacgcctgcaggtctaggaagagtgtgactagtttatactgtacagcaatattactactactccgtactacgtttccggcgtcgggaaccagggtcgaagatacgagaacgactggtcggc

SEQ ID NO: 334673 - DNA, 512 bp, Homo sapiens
  misc_feature: GZ8MTXP02IUKPS.25.38.D05.1.454.CMB.2.raw
  modified_base (463)..(463): a, c, t, g, unknown or other
  misc_feature (463)..(463): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagtctacaacaataaggacttcttagcttggtatcagcagaaaccagggcagcctctaagctgctcatgtactcgggctcgtaccgggatccccggtgtccctgaccgtattcgagtgggcgtcgggtctgggaccaggtactttcactctcacatcagcacgctgcagctagaacgatgtagactagttatactgtacagtactaatattatactactcgtntacgtttcgacggcggacaggtacgaagactacgagagaactgtaggtc

SEQ ID NO: 334674 - DNA, 565 bp, Homo sapiens
  misc_feature: GZ8MTXP02F6IK3.25.38.D05.1.454.CMB.2.raw
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaatccctgagactctcctgtgcaacntctggattcgccttcagttaacttgcatccacgtggtccncaggctccgaggcaagggactagagtgggtgtacttttagtgggctagtgagtggcaggtgaaataaaacgccttaagtgaccaagtaccgtcccgtacgaaacggggcccgtcttcctccactctaccagacgaacaaaccgccaaaggtaacgtaccggttacccgtttagactaaaacgtagaaaacgcctaaggacgaccgagacacggctatcgtattacgtgtacgcgagaacgcagtgagtgtacggctagg

SEQ ID NO: 334675 - DNA, 581 bp, Homo sapiens
  misc_feature: GZ8MTXP02HMEQ4.25.38.D05.1.454.CMB.2.raw
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
  modified_base (513)..(513): a, c, t, g, unknown or other
  misc_feature (513)..(513): n is a, c, g, or t
  modified_base (550)..(550): a, c, t, g, unknown or other
  misc_feature (550)..(550): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgacccagtctccagacctccctggctgtgtctcgtgggcgagacgggccaccatcaactgacaacgtccagccagtagttatttttacagtcctaccaaacaataacggacttcttagcttaggtatcagacaagaaaccgaggcacgcctacctaagctgctcatgtacgtgggccgtaccggtacccggatccccggtcgtcccgtgaccgtattccgaggtcggggccgggtcgggtccgtagggacctagactttcactctcacatcagcacgtccagcacggntaggaatgtaggtgacttagtttaactcgngtacatacaaattattactaacgttccgtccggttntaccggttccggggacggaccgggaaccgtaaggggngaacgacgacgaaacggactacgtcggtgcc

SEQ ID NO: 334676 - DNA, 540 bp, Homo sapiens
  misc_feature: GZ8MTXP02JJFFF.25.38.D05.1.454.CMB.2.raw
  modified_base (342)..(342): a, c, t, g, unknown or other
  misc_feature (342)..(342): n is a, c, g, or t
  modified_base (498)..(498): a, c, t, g, unknown or other
  misc_feature (498)..(498): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccaggccggggggtccctgagactctcctgtgcagcctctggattcagttttagcagattttggatgagctgggtccgccaggccccaggggaggggctggtgtgggtagccaanatacacgaagatggaggtagagaaatactagtgacgggactcgtgtaggaagggccgaagttcaacccatcctaccagggacaacctaccaaacaactacagtatatctagacaaatgaatggtctgagagccgaggacacggctgtgtactttcngtcgcgagacgtcgaccccgaatccgattacgaccctattcg

SEQ ID NO: 334677 - DNA, 520 bp, Homo sapiens
  misc_feature: GZ8MTXP02HKLJ5.25.38.D05.1.454.CMB.2.raw
  modified_base (305)..(305): a, c, t, g, unknown or other
  misc_feature (305)..(305): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaagtccctgagactctcctgtgcaacatctggattcgcttcagtaacttggcatccacgtggtccnccaggctccgaggcaagggactagagtgggtgtacttttagtgggcatgatggcagtgaataaagcctatgcagactcgtcaaggccgacttctcatctccagacgacaacgccaagaacgtacgtcctttagacaaatagaaaagcctagacgacccgagacgacgactatacgtattacagtcgacgagaacgcgagtgagacgtggacaggg

SEQ ID NO: 334678 - DNA, 664 bp, Homo sapiens
  misc_feature: GZ8MTXP02HETNR.25.38.D05.1.454.CMB.2.raw
  modified_base (312)..(312): a, c, t, g, unknown or other
  misc_feature (312)..(312): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaacgtccctgagactctcctgtgcaacatctggattcgccttcagttaactttggcatccactggggtccccnccgagcctacgaggacgaaggactaggaggtggtagttacgttttagtggactagtgagtcggacgtagttagaaactaaacggtcctaagtcgaccgtaacggtacccgtacccgtaacggaacggggtcccgtacttccctaccctactccctacgaacgacgaaccgaaaccgaaccgtaaacgaaacggttaccgttacctttacgaaactaaaacgtaacgaaaacgaccgtaacggaaccggaacccggaacggtaaccgacggtacgttaagttaacgttacgttacgtacggtacgacggaacgaacgacgtaaggtacggaggtacggtacggtacggtacgg

SEQ ID NO: 334679 - DNA, 521 bp, Homo sapiens
  misc_feature: GZ8MTXP02GD622.25.38.D05.1.454.CMB.2.raw
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaagtccctgagactctcctgtgcaacatctggattcgccttcagtaactttggcatccactgggtccncaggctccaggcaagggctagagtgggtntacttttatgggcagtgatggcngtgataaagcctatgcagactcgtcaaggccgcttctcactctaccagagaacaacgaccaaagaagaccggtacctttgactaaagtacgaaaagccctagacgacccgaggacacggctatgtattactgtgcgagaacgcgaagtcgagagtcggctagg

SEQ ID NO: 334680 - DNA, 555 bp, Homo sapiens
  misc_feature: GZ8MTXP02IU50C.25.38.D05.1.454.CMB.2.raw
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagtattttggatgagctgggtccgccaggccccgaggggaggggctgggtggtggggtagccgaaacatacacggaagagtgggaggtagaagaaattactagtgacggactcgtggtggaaaggggccgattcaccatctccgagggacaacctaccaaacaactcatatatctagacaaatgaatggtctgagagccgagacgacggctgtgttatttcgtgtcgacgagtacgtcgaccccgaatcccaagtactacccttattcg

SEQ ID NO: 334681 - DNA, 637 bp, Homo sapiens
  misc_feature: GZ8MTXP02J14YC.25.38.D05.1.454.CMB.2.raw
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtgggttttcctcgttgctcttttaagaggtgtccagtgtcaggtgcagctggtggagtctgggggagcgtggtccagcctgggaactccctgagactctcctgtgcaaacntcgtgatcgccttgagttaacttggctactccgacgtcgggtcccgcgacggcctaccgaggacgaaagggtactaggaggtgggtnttacgttttaggtgggcagtgagtcggacgngtagtaagtaaacgtactagtagacgacgaccgtaccgtacgaacgggtaccgtccgttcctcctactacctaccgacgacgaaccgaaccgaaccgaaacgaacggtaccggttaccgtttacgtaacgtaaacgtaacgtaaaacgaccgtacggaacggaaccggaacggaacgacggtacgtacgtacgtacgttacgtacgtacgtacgacgaacgacgacggtacggtaggacggtacggacgtcgg

SEQ ID NO: 334682 - DNA, 606 bp, Homo sapiens
  misc_feature: GZ8MTXP02GPG6O.25.38.D05.1.454.CMB.2.raw
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggactccctgagactctcctgtgcaacatctggattccgccttcagttaactttggctatcccacgtcgggtcccgccaggcctaccgaggccgaaaggggactaggaggtggggtagtactttttagtggggctagtgatggcaggtgaataaagcctaagtcgacagacctcgtacgaacgggccgtacttcctccactcctaccgagacgaaccaaacgacccgaaaggaacgtaccgttacctttagaacctaaaagtacgaaaacgccgtaacgacgaacccggaggaccgaacggtactaagtacgtaattacgtagtacgacgaagaacggacgtaggtagaggacggtcggacgtacggg

SEQ ID NO: 334683 - DNA, 531 bp, Homo sapiens
  misc_feature: GZ8MTXP02GKU2P.25.38.D05.1.454.CMB.2.raw
  modified_base (286)..(286): a, c, t, g, unknown or other
  misc_feature (286)..(286): n is a, c, g, or t
  modified_base (437)..(437): a, c, t, g, unknown or other
  misc_feature (437)..(437): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaacaataaggacttcttagcttggtatcagcagaaaccnggcagcctctaagctgctcatgtactgggctcgacccgggatccccggtacgtccctgaccgtattcgagtcggcgggcgggtctgggactagtacttcacgtctcacatcagcacgctgcagctagagagtcgtggactagtttattacngtacagtactaatattacgtaacttacgtccggttactacggtttcggcggtcgggaacctaggtagaagtatcgaacgacgacgtgtacggtc

SEQ ID NO: 334684 - DNA, 555 bp, Homo sapiens
  misc_feature: GZ8MTXP02I0TEY.25.38.D05.1.454.CMB.2.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (513)..(513): a, c, t, g, unknown or other
  misc_feature (513)..(513): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtggttttcctcgttgctcttttaagaggtgtccagtgtcaggtgcagctggtggagtctgggggagcgtggtccagcctgggaatccctgagctctcctgtgcaacntctggatcgccttcagtactttggcatccacgtgggtccnccaggcctccgaggcaaaggggctaggagtggggtntacttttagtgggctagtgatggctaggtgaaataaagccctaagtggcagtacctccgtacgaacggggcctcttcctacctactcctcccgaagacgacaaaccgacctaaagaacgtacggttcctttagaactaaagtagaaaacgcgaggaacgaccgacggacacggtntagtgtattactgtgcgagaacgcgagtgaaggcggtgcgag

SEQ ID NO: 334685 - DNA, 621 bp, Homo sapiens
  misc_feature: GZ8MTXP02HLC9B.25.38.D05.1.454.CMB.2.raw
  modified_base (259)..(259): a, c, t, g, unknown or other
  misc_feature (259)..(259): n is a, c, g, or t
  modified_base (322)..(322): a, c, t, g, unknown or other
  misc_feature (322)..(322): n is a, c, g, or t
  modified_base (443)..(443): a, c, t, g, unknown or other
  misc_feature (443)..(443): n is a, c, g, or t
tcagactgtacagtcacgaccggtgctcgatttagtatctgatagttgggtttgggggagctacaacaggcaggcaggggcagtaagatggtgttgcagacccaggtcctcatttctctgttgctctggatctctggtgcctagtggggacatcgtgatgacccagtctccagacctccctggctgtgtctcgtgggcgaggagggccaccatcaactgacaagtccagccaagtagttatttttacagtctaccaaanaagtaaggtacttctagtcttaggtatcagacaacgaaccgaggcacgcctactagctgctanatgtacgtgggctaccgtaccggacgtccggtccgtcccagacccgtattcgaggtcggcggggtcgggtcgtaggggactagttactttacaccttcacacccatacgagtcacgtccgngacgagacgtaggaagtgttaggtagttacttagtttactacgtcgtacgagtaacttaattacttactaccgttaccggttaccggttacgttaccggggttccgggacgggtaccggtaacgtaggggtacgaacgtaacgtaacgaaaggtaacgtacgtacggtacgtacgtcg

SEQ ID NO: 334686 - DNA, 505 bp, Homo sapiens
  misc_feature: GZ8MTXP02FGDPJ.25.38.D05.1.454.CMB.2.raw
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctggcgagagggccaccatcaactgcaagtccagccagagtattttttacagctccaacaataaggacttctagcttggtatcagcagaaaccagggcagcctacctaagctgctcatgtactgggcgtctaccccgggaatccccggtgtccctgacccgattccagtggcgggcgggtcgtgggacagatttcactctcaccatcaagcagcctgcagctgagatgtgctagttattactgtnancaataatatactactaccgtctacttcggcggcggaccgaagtaggaaganacacgacgaacgngngcg

SEQ ID NO: 334687 - DNA, 566 bp, Homo sapiens
  misc_feature: GZ8MTXP02GC0U4.25.38.D05.1.454.CMB.2.raw
  modified_base (312)..(312): a, c, t, g, unknown or other
  misc_feature (312)..(312): n is a, c, g, or t
  modified_base (532)..(532): a, c, t, g, unknown or other
  misc_feature (532)..(532): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaacgtccctgagactctcctgtgcaacatctggattcgccttcagttaactttggctatccacgtgggtcccncaggctccgaggcaaagggctagaggtgggtatacttttagtggggcagtgatgggctgtgaaataaagcctaatcggacagactccgtacgaacgggcccgtcttcctaccactcctaccagacgaacgaaaccgaccaaaggaacgtacggttacctttacgactaaagtaagaaacgcgtacggaacgacccgaggacacggactatcgtattacgngtacgcgagtaagcgaggtgaagcgtggcgtagg

SEQ ID NO: 334688 - DNA, 485 bp, Homo sapiens
  misc_feature: GZ8MTXP02JF8KQ.25.38.D05.1.454.CMB.2.raw
  modified_base (278)..(278): a, c, t, g, unknown or other
  misc_feature (278)..(278): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (484)..(484): a, c, t, g, unknown or other
  misc_feature (484)..(484): n is a, c, g, or t
tcagactgtacagtcacgaccggtgctcgatttagtatctgatagttgggtttggggagctacaacaggcaggcaggggcagcaagatggtgttgcagacccaggtcctcatttctctgttgctctggatctctggtgcctatggggacatcgtgatgacccagtctccagactccctggctgtgtctctggcgagaggccaccagtcaactgcaagtccagccagagtatttttacagctcaacaataagacttctagctggtatcagcagaaaccnggcagcctcaagctgctcatgtactggcgtctaccgggaatccccggtgtccctgaccgattcagtgggcgcgggtctggggacaggattcactntcaccatcacncncncngcgagcgagagagtgtgtgtagttatatgtcananatatatactacgtcgtctacgtcgcggacgacgagagaagagacgagagacgtacgtgng

SEQ ID NO: 334689 - DNA, 688 bp, Homo sapiens
  misc_feature: GZ8MTXP02F859I.25.38.D05.1.454.CMB.2.raw
  modified_base (225)..(225): a, c, t, g, unknown or other
  misc_feature (225)..(225): n is a, c, g, or t
  modified_base (595)..(595): a, c, t, g, unknown or other
  misc_feature (595)..(595): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagcgtggtggacgtcgggtgggggnggtcggtcggtccgacgtccggtagggaaccgtcccgtaggacgtacctcctccgtgtcgaccaactatcgtaggtacttccgtccttacgtaacgttacgtttggactacctacccgtacggttccgggtccccgaccggacggtccctaccggacggacggaaacgggtacgtaggtaggggttggggtacgtttacgtttttaggtcgggactagtgtagtcggacgtaggtagtaaagtaaacgtccttaagtcgacgtaacgtacccgtccgtaacggaccgggccttacttcccactacttccaccgagaaccaacaaccgacgaaaggacggttaccgtttcttagaactaaagtaacgaacncgtaagaccgaccgagacgacggtactagtacgttaactacgtgacgacgaagaaccgtacgtaggtacggaaggtggacggtacgtacgggg

SEQ ID NO: 334690 - DNA, 585 bp, Homo sapiens
  misc_feature: GZ8MTXP02F6C2O.25.38.D05.1.454.CMB.2.raw
  modified_base (164)..(164): a, c, t, g, unknown or other
  misc_feature (164)..(164): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtggtttccncgttaggctctttaagaggtgtccagtgtcaggtgcagctggtgggagtcgtgggggaggcgtggtccaggcctggggaacgtccctgagactctcctgtgcaaaccntctgntcnctnagttactgcntcngtcggccncagcncgagcgagganagngtggtgtatttgtggnagtgngtggangtagaaataacgctagngacgacgtaccgtccgtacggacggtccgtcttcctcctactccgaccgacgacgaaccaaccgaacgtaaaggtaacggttaccgttaccgttacgaacgtaaacgtaacgaaacgtccgtaacgaccgaccgacgtacgtacggtacgtacttacgttaacttacgtacgacgacgacgaacgacgtacggacggaggtacggtacggacgtacgg

SEQ ID NO: 334691 - DNA, 568 bp, Homo sapiens
  misc_feature: GZ8MTXP02G8MPO.25.38.D05.1.454.CMB.2.raw
  modified_base (357)..(357): a, c, t, g, unknown or other
  misc_feature (357)..(357): n is a, c, g, or t
  modified_base (526)..(526): a, c, t, g, unknown or other
  misc_feature (526)..(526): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccggggggtccctgagactctcctgtgcagcctctggattcagttttagctagtattttggatgagcgtgggtccgccgaggcccccgaggggaacggggctgggtggtggggtagcccaaanatacgacgaagagtgggaggtgaagaaatactagtgcggactcgtgtaggaaggggccgattcaacccatccgtccgaaggggaaccaaccgtacccaaacaacctacagtatatctagactaaatgaaatggtactgagacgccgaggacgacggctgtgtactttgngtgacgagacgtcgacccccgaatccatacgacccgttatcg

SEQ ID NO: 334692 - DNA, 509 bp, Homo sapiens
  misc_feature: GZ8MTXP02F57RL.25.38.D05.1.454.CMB.2.raw
  modified_base (306)..(306): a, c, t, g, unknown or other
  misc_feature (306)..(306): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaagtccctgagactctcctgtgcaacatctggattcgccttcagtaactttggcatccactgggtccnccaggctccaggcaaaggggctagagtgggtgactttatggggcatgatggcagtgataaagcctatgcagactccgtcaagggccgcttctccatctccagagacaaacgccaaagaagacggtcctttagcaaatagaaaagcctagagacccgagacacggctatgtattaactgtgcgagaagcagtgagagtggcagg

SEQ ID NO: 334693 - DNA, 589 bp, Homo sapiens
  misc_feature: GZ8MTXP02FOKN2.25.38.D05.1.454.CMB.2.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggaatccctgagctctcctgtgcaacatctggattcgccttnagtaactttggcatccacgtcggtccncaggctccgaggacagggactagagtggtgtactttagtgggctagtgatggactaggtagaataaaacgcccttaagtcgacctaagtaccgtaccgtacgaacggggcccgtcttcctaccgacctctacccagaacgaaccaaacgacccaaagaacgtacggttacctttagacaaagtagaaacgctagaacgacccgaaggacacggactagtacgtacgttacgtgtacggcgaaggaacgtccgaaggtcggaaggtaggtacgggacgtagg

SEQ ID NO: 334694 - DNA, 632 bp, Homo sapiens
  misc_feature: GZ8MTXP02JMF57.25.38.D05.1.454.CMB.2.raw
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggccagccgtgggaactcccgtgagactctcctgtcgcaaacntcgtaggattccgcccttnaacgttaactttgcatcccacgtcgggtcccgccaggcctccgaggaccgaaaggggctaggacggttgggtatactttttagtgggactagtggatggactaggtnaaactaaacggtccctagtacgacgtacgtaacccgtacccgtacggaaccgggcccgtctttccctacctactcctaccgagacgaacaaacgaccaaaggaacgtaccgttactttacggaacaaagtagaaaacgcgtagacgaccgacgacgacgtacttatacgtaacttactcgtagacgaagaacggtacccgaaggtacggacggtaagggtcgggaaccgtacgggg

SEQ ID NO: 334695 - DNA, 537 bp, Homo sapiens
  misc_feature: GZ8MTXP02G9R7Q.25.38.D05.1.454.CMB.2.raw
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (462)..(462): a, c, t, g, unknown or other
  misc_feature (462)..(462): n is a, c, g, or t
  modified_base (518)..(518): a, c, t, g, unknown or other
  misc_feature (518)..(518): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgcaagtccagccagagttatttttacagtctaccaaacaataaggacttcttaagcttggtatcagcagaaaccagggcagcctccaagctgctcatgtacgtgggcgtacgtaccccgggtaatcccccgggtgtccccgtgaccgattccgaggttcggggcgggcgggtcgtggggacagtactttcgacttctcacatcagcancctgcagctagaaagntgtgctagttatacgtgtacganactaatacttatacgtactcggtctacgttcggcggtacggaccgaggtgaagtanacgacgacgacgtcgcgcg

SEQ ID NO: 334696 - DNA, 642 bp, Homo sapiens
  misc_feature: GZ8MTXP02FKPGJ.25.38.D05.1.454.CMB.2.raw
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (307)..(307): a, c, t, g, unknown or other
  misc_feature (307)..(307): n is a, c, g, or t
  modified_base (629)..(629): a, c, t, g, unknown or other
  misc_feature (629)..(629): n is a, c, g, or t
tcagactgtacagtcacgaccggtgctcgatttagtatctgatagttgggtttggggtagctacaacaggcaggcagggcagcaagatggtgttgcagacccaggtcctcatttctctgttgctctggatctctggtgcctatgggacatcgtgatgacccagtctccagactccctggctgtgtctctgtcgagaggccaccatcaactgcaagtccagccagagttattttaanacngtcctaaccaacaagtaacggtctttacgtagtcgttaggtatacgacgcaaacgaaaaccccggggnggactaccgtaccctacgtagtcgtcgtctacgtagttacggttacgggtcgggtcccgtaccccggtaacccggtaccgttccggttccgtcccgtacgtaccgttactcggtggtcgggtcggtcgttacggtacgtagtacttacttacctacctcctaccactactacgacgacgtcgcgtcgacggacgtagtaagagtagtcggtcggtacgtttatttacgttacgtacgtacgactaactaattaattaacttaccgttacctccggttaccgtcgacgggtccggtacgacggtacggaagagtacgacgaanaacgtagacgtcg

SEQ ID NO: 334697 - DNA, 521 bp, Homo sapiens
  misc_feature: GZ8MTXP02GGG0I.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaacaataaggacttctagcttggtatcagcaagaaaccaggcagcctcctaagctgctcatgtactgggctcgtacccgggatccccggtgtccctgaccgattcgagtcgggcgggcgggtcgtgggacagtatttcactctcaccatcagcacgcctgcaggctagaagagtgtggctagtttattactgtcagcaatatatactactccgtctacgtttcggcggacggaccgaaggtaggaagacgtacgacgacgaacgtgtacgtacg

SEQ ID NO: 334698 - DNA, 573 bp, Homo sapiens
  misc_feature: GZ8MTXP02JPLU1.25.38.D05.1.454.CMB.2.raw
  modified_base (308)..(308): a, c, t, g, unknown or other
  misc_feature (308)..(308): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaagtccctgagactctcctgtgcaacatctggattcgccttcagttaacttggcatccactcgggtccncaggcctcgaggcaagggactagaggtgggtatacttttgtgggcagtgatggcaggtgaataaagcctaatcgacagacctccgtcgaacgggccctcgttctccactcctaccagacgaacgaaaccgaccaaaggacgtaccgttacctttacggactaaaatagaaaacgccgtagaacggacccgaggaacctacggactagtacgttaattacgtagtcgacgagtaacgaccgaggtacggagacggtggactacggg

SEQ ID NO: 334699 - DNA, 599 bp, Homo sapiens
  misc_feature: GZ8MTXP02F0D56.25.38.D05.1.454.CMB.2.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (591)..(591): a, c, t, g, unknown or other
  misc_feature (591)..(591): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccaggcctgggaacgtccctgagctctcctgtgcaacntcgtggattcgccttnagttaactttggctatcccacgtcgggtcccnccgaggcctccgaggcaaagggctaggaggtgggtntacttttagtgggcagtgagtggactaggtgaaataaacgcctaagtcgactacgtaccgtccggtacgaacggggtcctacgtttctaccatccgtaccgaagacgaaccaaccgaccgaaaggaacgtaccggtttacctttagaactaaacgtacgaaaacgtcctaggaccgaaccgaggaccacggtactagtacgttaatacgtgtacgacgaagcgacgagtacgagtacggngacgtagg

SEQ ID NO: 334700 - DNA, 620 bp, Homo sapiens
  misc_feature: GZ8MTXP02I69OA.25.38.D05.1.454.CMB.2.raw
  modified_base (371)..(371): a, c, t, g, unknown or other
  misc_feature (371)..(371): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagacgggccaccatcaactgcaagtccagccagagttatttttacagctaccaaacaataaggacttctagcttaggtatcagcaagaaaccgagggcacgtcctacctaagctagctcatcgtacgtgggccgtaccgtaccccgggatccccggtcgtccccgtgacccgtnttccgaggttcggggccggcggggttcacggggacctaggtcttttaccaccttctccaacccattccagcacgctgccagggcctaggaaacgtgttcggtggtaccttaaggttttactaccgtgtacaagtactaaattcttaaacgtacttaccgttcggtacctacggtttaccgggcgggacgggtaaccgtaggtacgggaacgtaactaccggaaagaaacggtaacgttgggtacgtccg

SEQ ID NO: 334701 - DNA, 585 bp, Homo sapiens
  misc_feature: GZ8MTXP02GZES5.25.38.D05.1.454.CMB.2.raw
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaatccctgagactctcctgtgcaacntcgtggattcgccttnagttaactttggcatccacgtcgggtccnccaggctccgaggccaagggactagagttgggtagttacttttagtggggctagtggatggactaggtgaaattaaagcctaatggactagactccgtacgaacggccgcttctccactctaccacgacgactaaaccgaccgaaacgaacggtacgggttaccttttaggaactaaacgtagaaaacgccgtacgaacggaaccccgaggaaccacggccttagtacgtattactggtacgacgaggaacgcgagtggagacggtcggacgtagg

SEQ ID NO: 334702 - DNA, 511 bp, Homo sapiens
  misc_feature: GZ8MTXP02GDEO8.25.38.D05.1.454.CMB.2.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgccttcagtaactttggcatccatgggtccncaggctccaggcaagggctagagtgggtntactttagtgggcatgatggcagtgaataaagcctaatgacagactccgtcgaagggccgcttctccactctccagagacaacgaccaagacgacgtcctttagactaaatagaaagctagacgaccgagacacgctatgtattactgtcgcgagaagcgagtgagagtggactagg

SEQ ID NO: 334703 - DNA, 600 bp, Homo sapiens
  misc_feature: GZ8MTXP02IRU83.25.38.D05.1.454.CMB.2.raw
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
  modified_base (472)..(472): a, c, t, g, unknown or other
  misc_feature (472)..(472): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatgacccagtctccagactccctggctgtgtctcgtgggcgagacgggccaccatcaactgacaagtccagccagtagtttatttttacacgtcctacccaaaactaaagtaacggtactttcttaagtctttagggtactcagacaaggaaacccgngggcacgtcctacctaagctgctcatcgtacgngggtccgtccgtaaccgggactccccggtcgtccctacgaccgtattcgaggttcggggcggtcggggtcgagggacctaggtctttcactctaccaccatcagcacgctgacgagctagacgngtaggtgtacttagttactacgtgtacagtactaattacttactaaccttcgtccgttactacgggttccggacggtccgggaaacgtaggtaggaatacgtagtaacggaagtacgtggtacggtcg

SEQ ID NO: 334704 - DNA, 573 bp, Homo sapiens
  misc_feature: GZ8MTXP02GSJSP.25.38.D05.1.454.CMB.2.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaactccctgacgactctcctgtgcaacntctggattcgccttnagttaacttggcatccagtcgggtccncaggctccgagcgaagggactagaggtggtattacttttagtgggactagtgagtcggactaggtacgaataaaacggtccctaagtcgacaacgtaccgtccgtacggaacggcccgtcttccctcactcctacgagacgacaacgaccaaagacgtacgttctttagacaaagtagaaacgctacgacgaccgagaccgacggtactatagtactacgtgtacgacggagaacgacgaggtcgaggtaggtcgacgtacggg

SEQ ID NO: 334705 - DNA, 535 bp, Homo sapiens
  misc_feature: GZ8MTXP02JHDMD.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagttatttttacagctaccaacaataaggacttctagcttggtatcagacaagaaaccagggcagcctacaagctgctcatgtactgggctcgtacccgggatccccggtgtccctgaccgtattcaggtgggcgggcgggtcgtgggacaggtactttcacctctaccaccatcaagcacgcctagccagctagagatgagctagtttatacgtgcagactaatattatactacgtcggtctacgttcggacggtcggaaccgtaaggtcgaagtacgtacgaaaggacgtaacgtcggtaggac

SEQ ID NO: 334706 - DNA, 591 bp, Homo sapiens
  misc_feature: GZ8MTXP02JHJBF.25.38.D05.1.454.CMB.2.raw
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggatccctgagactctctgtgcaacatcnggntcgccttnagttaacttgactatccacgtcgggtccnccaggcctcgaggcaagggctagagttgggtatacttttagtggctagtgatgggactaggtagaaattaaacggcccttaaagcggacctaacgaccgtcccggtacgaacgggcccgtcttcctacccactcctacccgagacgaacaaaccgacctaaaaggaacgtaccggttacctttagaacctaaaagtagaaacgtcctaggaccgacccggaagaccgacgtactatagtattactagtcgacgagaacgtcgaagtaggagtacggaggacgtagg

SEQ ID NO: 334707 - DNA, 571 bp, Homo sapiens
  misc_feature: GZ8MTXP02GHGAD.25.38.D05.1.454.CMB.2.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (362)..(362): a, c, t, g, unknown or other
  misc_feature (362)..(362): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgctcttttaagaggtgtccagtgtcaggtncagctggtggagtcgtgggggagcgtggtccagcctgggaatccctgagactctcctgtgcaacntcnggattcgcttcagtacttgcatccatcgggtccncaggctccgaggcaagggctagagtggtntacttttagtgggactatggatggacaggtnaaataaacgccttaatgacagactcgtgtacgaagggccgtcttctccatcctaccagacgaacaaacgaccaaagaacgtaccggttacctttaggaacctaaaagtaacgaaaacgacctaggaacgaacccggaaggaaccgacggacttaacgtcgttaacttacgtacgtgacgaagacgaccgagtgacggtacggacggacg

SEQ ID NO: 334708 - DNA, 644 bp, Homo sapiens
  misc_feature: GZ8MTXP02JMA7L.25.38.D05.1.454.CMB.2.raw
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (601)..(601): a, c, t, g, unknown or other
  misc_feature (601)..(601): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaacgtccctgagcctctcctgtgcaacatcgtggacttcgccttnagttaacttggactatcccacgtcgggtccnccgtaggcctaccgaggacgaaagggactaggaggtggggttatacgtttttagtggggactagtgacgttggactaggtacgaaagtaaacgcctagtcgactacgaccgtcgtaacgacgggtcctcttccgtaccacttaccgacccaacggaaccgaaccgaaaccgacccgaaaaggtaacggttaccccgggttactttaacggaacctaaaagtacggaaaacgtacccgtagaacccggaaccgacgaccgacggtacctagtacgtagtttaaccgngtacgacgagaacgacgtaggtacggagtacggtcggacgtgg

SEQ ID NO: 334709 - DNA, 642 bp, Homo sapiens
  misc_feature: GZ8MTXP02J3INI.25.38.D05.1.454.CMB.2.raw
  modified_base (181)..(181): a, c, t, g, unknown or other
  misc_feature (181)..(181): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggaactccctganactctcctgtgacaacntcgtggacttcgccttacagttaacctttggctatcccacgtcgggtcccncaggcctaccgaggacgaaaggggactaggtagttcggggtagtacctttttagnggggactagttggattgggacaggtagtaaacttaaacggccttaaagtcgaccgacggtaccttacccggtacgaaacgggtcccgtaccttccctccgtatcctaccgaagacgaaaccgaaacgacccgaaaggtaacgtaccggttactttacggaactaaaagtacggaaaaacgccgtaacggaccgaacccgaacggacaacggtactaagtacgttatacgtcgaggacgagcgacgaggtaggacgaggtcggctacggg

SEQ ID NO: 334710 - DNA, 532 bp, Homo sapiens
  misc_feature: GZ8MTXP02FZ5TD.25.38.D05.1.454.CMB.2.raw
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccaagtagttatttttacagctaccaacaataaggacttcttaagcttaggtatcagcaagaaaaccagggcacgcctacctaagctgctcatgtactgggccgtcgtacccggatccccggtcgtccctgaccgtattcgagtcgggcggcgggtcgngggacagtattcacttcncaccatcagaccacgctacgcagctagaagaagtgtgtagtagtttattactgtananataatatatactactacgtactacgtcggacggacggacgaaggagaagagacgagaagacgtacgtacgtcg

SEQ ID NO: 334711 - DNA, 564 bp, Homo sapiens
  misc_feature: GZ8MTXP02F70DD.25.38.D05.1.454.CMB.2.raw
  modified_base (313)..(313): a, c, t, g, unknown or other
  misc_feature (313)..(313): n is a, c, g, or t
  modified_base (563)..(563): a, c, t, g, unknown or other
  misc_feature (563)..(563): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtgggttttcctcgttgctcttttaagaggtgtccagtgtcaggtgcagctggtggagtcgtgggggaggcgtggtccagcctgggaagtccctgagactctcctgtgcaacatctggattcgccttcagttaactttggacatccacgtcgggtcccnccaggcctccgaggcaaaggggactaggagtgggtgtactttttagtgggacagtgatggcaggtgaaataaagcctaatcgacagtacctccgtacgaacggggccctctttcccacactcctacccaagacgacaaacggaccaaagacgtacgtcctttagacaaatagaaaacgcctaggacgaacccgtaggactacggactagtagttactactgtaggcagaacgcgagtggaagcgcgacgng

SEQ ID NO: 334712 - DNA, 579 bp, Homo sapiens
  misc_feature: GZ8MTXP02IYV0V.25.38.D05.1.454.CMB.2.raw
  modified_base (354)..(354): a, c, t, g, unknown or other
  misc_feature (354)..(354): n is a, c, g, or t
  modified_base (457)..(457): a, c, t, g, unknown or other
  misc_feature (457)..(457): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtccctgagctctctgtgcagcctctggattcagttttagcagtattttggatgagtcgtcgggtccgccgaggcccccgaggggaacggggctgggtggtgggtacgcccaanatacgacgaagagtggaggtagaagaaatacgtatgacgggtactcgtgtagggaacgggccaacgttcacccatcctaccgaggaacaacctacaaacaacncatatactactagacaaagtgaactggtactaggagaacggccggaaagggacgacggtcgtggttaggtttactttcggtgtgacgtagtacgcgaccccgataccataccgacctattcg

SEQ ID NO: 334713 - DNA, 595 bp, Homo sapiens
  misc_feature: GZ8MTXP02I0OER.25.38.D05.1.454.CMB.2.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (554)..(554): a, c, t, g, unknown or other
  misc_feature (554)..(554): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggtttcctcgttgctcttttaagaggtgtccagtgtcaggtgcagctgggtggagtcgtgggggagcgtggtccagcctgggaatccctgagctctcctgtgcaantctggatcgccttnagtacttgcatccagtgggccncaggcctcgagcaaggctagaggtggatacttttagtggctagtgatggacaggtgaaataaacggccttagcgacacgtaccctccgtacgacggggtccctactttccctaccacttcctacccgaaggaacgaacccgaaaccgacccgaaaagggaaacggttaccggttaccctttaggaaacctaaaagttacgaaaacggtccgtaaaggacccgaaccggagaccacggtactaagtcgttattacgngtaccgagacgaacgcctaaggtcgaggagtcggagtacgg

SEQ ID NO: 334714 - DNA, 623 bp, Homo sapiens
  misc_feature: GZ8MTXP02IFST1.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccacatcaactgcaacgtccagccagtagttatttttacagctacaacaataagacttcttagtcttgtatcagacaagaaaccgagggacacgcctacctaagctagtctatatcgtacgtgggtccgtaccgtacccgggtacgttccccggtcgtcccgtagaccgtattcgaggtcggggcgggtcggggtcgtacggggaactacggtactttccacctttacctaccaacctactacgaacgtccgaacgtcctacggccgtagaccgttaggaaagtgtgggtagtacgtttagtttacttacgttgtacaagtactaaattagttaactactaaccgtcgttacgtaccgtttcggggaccgtacggaccgtaaggtacggaacgtagtagaacgaagtactaggtacgaccg

SEQ ID NO: 334715 - DNA, 627 bp, Homo sapiens
  misc_feature: GZ8MTXP02JVRTR.25.38.D05.1.454.CMB.2.raw
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggttttcctcgttgcttcttttaagaggtgtccagtgtcaggtgcagctggtggagtcgtgggggagcgtggtccagccgtgggaactccctgacgactctcctgtgcaacntctggatcgcttcagtactttggctatccagtcggtccnccaggctccgaggcaaggctagagtggtntacttttgngggactatggatgggctggtagaataaaggccctaagtcgaccaagaccctacccggtacgaacggggtccctcttcctccgtactcctacccgagacgaaccgaaaccgaccgaaacggaacggtaacccgttccttttacggaaccgtaaaagtacggtaaaaaccggtccctaacggaaccgaaccccggggacgaaaccgaccggtacttagtacgttaagttacgtaggtcgaacggagaacgtaccgaagtacggagaggttcggacggtaggg

SEQ ID NO: 334716 - DNA, 543 bp, Homo sapiens
  misc_feature: GZ8MTXP02F5RQR.25.38.D05.1.454.CMB.2.raw
  modified_base (306)..(306): a, c, t, g, unknown or other
  misc_feature (306)..(306): n is a, c, g, or t
  modified_base (447)..(447): a, c, t, g, unknown or other
  misc_feature (447)..(447): n is a, c, g, or t
  modified_base (499)..(499): a, c, t, g, unknown or other
  misc_feature (499)..(499): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaagtgtccagtgtgaggtgcagttggaggagtctgggggagcttggtccaggccgggggggtccctgagactctcctgtgcagcctctggattcagttttagcagtattttggatgagctgggtccnccgaggccccaggggaaggggctgggtgtggggtagccaaacgatacgaacgaagatgggagtgagaaattactatgacggactctgtagacgggccgattcaccatcctacgaggaacactaccaacaactacagtatanctgacaaatgaatgtctagagacgccgaggacgacggtctgtgtatttcggngtacgacgtagacgtccgaccctaactacacgtacgacctatcg

SEQ ID NO: 334717 - DNA, 534 bp, Homo sapiens
  misc_feature: GZ8MTXP02H9VLA.25.38.D05.1.454.CMB.2.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggaatccctgagactctcctgtgcaacatctggattccgccttnagtaactttggcatccactgggtccnccaggctccaggcaagggactagagtggtntacttttagngggcatggatggcaggtnaataaacgcctaatgactagacctccgtcgaacgggccgctctccatctccagacgacaacgaccaaagaagacggttactttagacaaatagaaaacgcctagagaccgacgacgacggactatgtacttactgtgcgagaagaccgagaggagacggtggacgtagg

SEQ ID NO: 334718 - DNA, 634 bp, Homo sapiens
  misc_feature: GZ8MTXP02I52BH.25.38.D05.1.454.CMB.2.raw
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (332)..(332): a, c, t, g, unknown or other
  misc_feature (332)..(332): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaagtccctgagactctcctgtgcaacntctggatcgccttcagttacttgctatccagtcgggtccnccaggcctccgaggcaagggctaggngtggtgtactttttagtgggctagtgacgtggctaggtgaataaagcctagtacgacgacgacctccggtacgaacgggtcccgtcttcctacctactaccctaccgaacgacgaaccaaaccgaccgaaaaggaaccggtaccggttaccgttttacggaactaaaacgttaacggaaaaacgtccgtaacggaaccggaacccggaaagggaccgtaacccgggtattaacgttagttaaacgttacgtagtcggacgaagaacggaccgaaggtacggaggacgggttggacgtacggg

SEQ ID NO: 334719 - DNA, 514 bp, Homo sapiens
  misc_feature: GZ8MTXP02FFGQF.25.38.D05.1.454.CMB.2.raw
  modified_base (421)..(421): a, c, t, g, unknown or other
  misc_feature (421)..(421): n is a, c, g, or t
  modified_base (510)..(510): a, c, t, g, unknown or other
  misc_feature (510)..(510): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctggcgagagggccaccatcaactgcaagtccagccagagtattttttacagctccaacaataaggacttctagcttggtatcagcagaaaccagggcagcctcctaagctgctcatgtacgtgggcgtcgtacccgggtaatccccggtgtccctgaccgattcgaggtggcgggcggtctggggacaggtatttcactctcaccatcagcagcctgcagctagaagatgngctagtttattacgtgtcagacaatattataactacgtccggtctacgtttcggcggacggtaccaaggtgaagatcgagtacgactgngtcg

SEQ ID NO: 334720 - DNA, 711 bp, Homo sapiens
  misc_feature: GZ8MTXP02IMNCT.25.38.D05.1.454.CMB.2.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtcagtgtgaggtgcagttggaggagtcgtgggggagcttggtccgaggccggggggtccctgagactctcctgtgcagcctctggnttcagttttagcagtattttggatgagcgtgggtccgccgaggccccgagggaaggggcgtaggtggtggggtacnccgaaacgatacgaacgaacggagtacggggaggtagaaggtaaaacttacgtagttggacgggtaaccttcgttagggtacggaaacgggggcccgtaaagtttcccgaaccctagtacccgttacccgaacgggggtaaacctaaacccgttacccaaaacctaacccttaccgaaacggttaaacttaacgttaccttacggtaacctaaaagttacggtaaacttacgggttacctaggacgaacggacccggaaggaccgaacggtcgtacgttaggttaacctttgtcggttaggaccgtaaggtacggtcgacccccgaaattacccgaaagtaaccgtaccgttaacgtttaccgg

SEQ ID NO: 334721 - DNA, 566 bp, Homo sapiens
  misc_feature: GZ8MTXP02JL6C5.25.38.D05.1.454.CMB.2.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (521)..(521): a, c, t, g, unknown or other
  misc_feature (521)..(521): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattgggctgagctgggttctccttgttgctattttagaaggtgtccagtgtgaggtgcagttggaggagtcgtgggggagcttgggtccagggcccggggggtccctggagactctcctgtgcagcctctggattcagttttagcagtattttggatgagcgtgggtccgccaggccccaggggaagggctggtgtggggtagccaaanatacgacgaagatgggagtgaagaaatactagngcggactctgtacggaaagggcccgaattccgaacctatacctacccgaggggaaccaactacccaaacaactccaagtactatctagacaaaatgaaatcgtatagagagcggaagacgtacggcgtgtatacgttntggtcgacgagacgccgacccgtactaccactaccgtacctatcg

SEQ ID NO: 334722 - DNA, 600 bp, Homo sapiens
  misc_feature: GZ8MTXP02G0XG1.25.38.D05.1.454.CMB.2.raw
  modified_base (182)..(182): a, c, t, g, unknown or other
  misc_feature (182)..(182): n is a, c, g, or t
  modified_base (264)..(264): a, c, t, g, unknown or other
  misc_feature (264)..(264): n is a, c, g, or t
  modified_base (312)..(312): a, c, t, g, unknown or other
  misc_feature (312)..(312): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagnggtgtccagtgtcaggtgcagctggtggagtcgtgggggagcgtggtccagcctgggaatccctgagctctcctgtgcaacntctggattcgccttcaagttactttggctatcccacttcggggtcccnccgaggcctccgagggccgaaaggggtctaggaggttggggtatactttttaggtgggcagtgagtggcagttgaataaacggcctagtggactagactccgtacgaacgggccgtcttcctcactactacccgaagacgaacgaaaccgacgaaacgaacggtaccggttacctttaggaacctaaagtacggaaaacgccgtaggaacgacccggaaggaaccgaccggtactagtacgttattacgtgtcgacgagaacgcagtacgagtacggtggacgtacgg

SEQ ID NO: 334723 - DNA, 594 bp, Homo sapiens
  misc_feature: GZ8MTXP02JPFDZ.25.38.D05.1.454.CMB.2.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaactccctgagactctcctgtgcaacntctggattcgccttnagttaacttggcatccagtcgggtcccncaggcctcgaggacaagggactaggagtggggtatactttttagtgggctagtgatggcaggtgaaataaacgccttaagcgacaagtacctcccgtacgaacgggtcccgtcttccctacctactcctaccgacgacgaaccaaacgaccgaaaggaacgtaccggttacctttagaactaaaagtacgaaaacgtccgaacgaaccgaaccgacgaacgaccggtactagtacgtacttacgcgtacgacgagaacgacaggtacgagacggtcggacgacgg

SEQ ID NO: 334724 - DNA, 516 bp, Homo sapiens
  misc_feature: GZ8MTXP02GMCKT.25.38.D05.1.454.CMB.2.raw
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttattttttacagtctacaaacaataagacttcttagcttggtatcagcaagaaaccagggcacgcctactaagctgactcatgtacgtggcgtcgacccgggtatccccggtctccctgaccgtattcgagtgggcggtcggtcgtgggacagtacttcactctacacatcaagcncncngcagacgagagagtgtgtagtagttattactgtacanataatatatactactcgtctacgtcgcggacggacgagtagaagacgacgacgacgacgtacgtcgcg

SEQ ID NO: 334725 - DNA, 609 bp, Homo sapiens
  misc_feature: GZ8MTXP02JEIVW.25.38.D05.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgctcttttaagaggtgtccagtgtcaggtncagctggtggagtcgtgggggagcgtggtccagccgtgggaactccctgagactctctgtgcaacntctggattcgccttcagttacttggcatccatcgggtccnccaggcctccgaggccaaagggtctaggnggttgggtcttactttttaggtgggactagttggattgggacagggttagaaacgtaaaacgcctaagtcggactaacgtaccgtaccgtaccgtaacggggccgtcttcctaccacttccaaccgacgaacgaccgaaaccgaccaaacggacgtacggttacctttagaactaaagtacgaaacgtaccacgacgacccgagaaccgtacggactagttagtaacgttactgtacgcgtagaacgacgagtacggagagtacggacgtacgg

SEQ ID NO: 334726 - DNA, 534 bp, Homo sapiens
  misc_feature: GZ8MTXP02FHZHI.25.38.D05.1.454.CMB.2.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (532)..(532): a, c, t, g, unknown or other
  misc_feature (532)..(532): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggtaggcttgggtcccaggcccggggtttccgtgagactctcctgtgcagcctctggattcagttttagcagtatttggtatgagcgtgggtccgccaggccccgaggggaaggggcgtggtgtgggtagccaacntacacgaagatggaggtgagaaatactntgcggactctgtgaagggcgattcaccatctccagggacaactaccaacactacagtatatctgacaatagagtagtcgtgagagcggaggacgtaacggcgttgtgttatttctgttgcgagagtcgccccgaactccatacgaacccttntg

SEQ ID NO: 334727 - DNA, 575 bp, Homo sapiens
  misc_feature: GZ8MTXP02IQCS2.25.38.D05.1.454.CMB.2.raw
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaatccctgagctctcctgtgcaacntctggattcgccttcagttaactttggctatccacgtgggtcccnccgaggctccgaggccaaaggggactaggagtgggtgtactttttagtggggcagtgagtggcaggtgaactaaagcctatgacagtactccgacgaacgggccgtcgttcctcctactccgtaccaagacgacaaaccgactaaaggaacgtacgttaccttttacgaacgtaaactacgaaagccgtacgacgaccgaggacgacggactagtcgtattacgtgtacgcgtaagaacgccgtaggagtagaggtcggacgtagg

SEQ ID NO: 334728 - DNA, 651 bp, Homo sapiens
  misc_feature: GZ8MTXP02G3QMU.25.38.D05.1.454.CMB.2.raw
  modified_base (417)..(417): a, c, t, g, unknown or other
  misc_feature (417)..(417): n is a, c, g, or t
  modified_base (461)..(461): a, c, t, g, unknown or other
  misc_feature (461)..(461): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagacgggccaccatcaactgacaagtccagccagtagttatttttacagctaccaaacaataaggtcttacttagcgttaggtactcagacaagaaaccgagggcacgcctacctaagcctgtcctactatcgtacgtcgggccgtaccgtaaccgggtactccccggtcgtcccctagaccgtattccgaggtcgggcgggtcggtcgtaggactagtnttccactctacactagcagcagcctgacgacggcttaggaacgngtggtacggtacttaagtttaacttacgtgaaccgtagtaactaaatttaacgttaacttaacccgttacgttaccccgggttactttaaaccgggtttcccgggggacgggtaaccggggtaaaccgtaaaggggtacggtaacgtaacgtaccggaaaaggtacgtaaacggttgggtacggtaaccg

SEQ ID NO: 334729 - DNA, 596 bp, Homo sapiens
  misc_feature: GZ8MTXP02GJBN0.25.38.D05.1.454.CMB.2.raw
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaagtccctgagactctcctgtgcaacatctggattcgccttcagttaacttggcatccacgtggtccgcaggctcgaggcaagggctagagtggtagtactttagtgggcagtgatggacngtnaataaagcctaatgacagactcgtacgaacgggccgacttcctcacttcctaccgaagacgaaccaaacgacccgaaagtaacggtaaccggttaccctttttacggaacctaaaacgttaacgaaaacgtccgtaacgaacggaacccggaaaggaaccgaacgggtacctaagtacgttaattacgtagtacgacgagaacgacgaggtagagtaggtacggactacggg

SEQ ID NO: 334730 - DNA, 750 bp, Homo sapiens
  misc_feature: GZ8MTXP02GRQ7B.25.38.D05.1.454.CMB.2.raw
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctatttagaaggtgtccagtgtgaggtgcaggttgggaggagtcgtgggggaggtcgttgggtccgagggcccggggggtccctggacgactctcctgtgcagcctcgtggattcgagttttagctagtattttggatgagcgtcgggtccgccgacggccccgaggggaacggggcgttaggggtgggtggggtacgccgaaacgataaccgaggaagagtggggaagtacggaagtaaattacgtagtacgggcgtaaccgtcgttggtaacgggaaacgggcccgtaaattccgaaaccctagtacccgtaccggaacggggaaacccaaaccttacccaaaaccgtaaaccttaccgaaagttaaactaacttaccgttaagtaaaccaaaagtttaggaaaacgttgggttcctaaagggaacggtaacgggacccggaaacggggtaaccgaccgggttacgtacggttacgtttaagttttccgaggttccggacgtaaaggttccggaacccggtaccccccggtaaaattaccccgaaaaggttaacccgtacccctttaaagtttcccgg

SEQ ID NO: 334731 - DNA, 539 bp, Homo sapiens
  misc_feature: GZ8MTXP02FSTSG.25.38.D05.1.454.CMB.2.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggngcgtggtccagcctgggatccctgagctctcngtgcaantcngatcgccttnagtacttgcatcacgtggccncaggctccgaggcaaagggctaggagtggtatacttttagngggcagtcgattggacaggtgaactaaacgccttagtcgacacgtactccgtacgaacggtccgtcttctacctatctaccgagacgacaacgaccaaagaacgtacgttcctttagactaaagtagaaacgcgtagacgaccgagacacggctatacgtatacgtgtacgcgagtaacgacgagtcggagtaggcgcgtacgg

SEQ ID NO: 334732 - DNA, 612 bp, Homo sapiens
  misc_feature: GZ8MTXP02GML9Y.25.38.D05.1.454.CMB.2.raw
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaatccctgagctctcctgtgcaacntctggattcgccttnagtactttggcatccagtcgggtccncaggctcgaggcaaggctagagtggtntactttagtggcagtgatggcagtgaataaagccttaagtcgacacgactccgtacgaacggggtcccgtcttacctccgtactcctaccgaacgacgaaccaaaccggacccgaaaacggtaacgtaccgggtttacctttaacgaaccgtaaaagttacggaaaacgtaccgtaacgaaccggaacccggaacggaaccgacggtaccgttaagtacgtttaacgttacgttacgtacgaccgaagaacgtaccgaagtacgagtaggcggacgtagg

SEQ ID NO: 334733 - DNA, 611 bp, Homo sapiens
  misc_feature: GZ8MTXP02FRINJ.25.38.D05.1.454.CMB.2.raw
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (446)..(446): a, c, t, g, unknown or other
  misc_feature (446)..(446): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagacctccctggctgtgtctctgggcgagagggccaccatcaactgcaagtccagccagtagttatttttacagtctaccaaacaataaggacttcttagcttggtatcagcaagaaaccgagggacacgccctacctaagctgcctcatgtacgtcgggctaccgtaccccgggaatccccggtcgtcccncgaccgtnttcgacgtggggcgggcgggtcgtaggggacctagtactttccactccacctacaatcagcaccgtcagcgaacgngtaggaaagtgtgggtagtcgttaagggttttaactaccgtgtaccgagttaactaaattactttaatacccgtacgttccccggggtacttacggtttaccgggacgggtaacgggtaccgaaggtacggggaattacgagtaacgaccgtaacgttgcggtcg

SEQ ID NO: 334734 - DNA, 558 bp, Homo sapiens
  misc_feature: GZ8MTXP02FPYF1.25.38.D05.1.454.CMB.2.raw
  modified_base (255)..(255): a, c, t, g, unknown or other
  misc_feature (255)..(255): n is a, c, g, or t
  modified_base (353)..(353): a, c, t, g, unknown or other
  misc_feature (353)..(353): n is a, c, g, or t
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagacctccctggctgtgtctcgtgggcgagagggccaccatcaactgcaagtccagccagtagttactttttacagctaccaaanaataaggacttctagtcttaggtactcagcgaagaaaccgagggcacgcctactaagctgctcatgtacgtcggctacgtaccggatcccggtctccngacctattcgaggtcgggcggcggtcgtacggggactacgtatttcgactctaccacatacngacacgctgactagctaggatagtggtagattacgtttatacgtgtacanactaattattactactaacgtccggtactacggtttacggcggtacggtaaccgagggtagaagtactacgacgtacgtaagtcgtacggtcg

SEQ ID NO: 334735 - DNA, 654 bp, Homo sapiens
  misc_feature: GZ8MTXP02IXL4E.25.38.D05.1.454.CMB.2.raw
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggaacgtccctgagacctctcctgtcgacaacatctggattcgccttnagtaacttgcatcccacgtcggtcccnccgacggcctacgaggaccaaaggggactaggaggtgggtatacttttagtgggctagtgatcggctaggtgaaataaacgccttagtacgacgacgtacctcccggtacgaacggggccctcgtttccctacctactacctacccgaaggaaccgaaccgaaacccgaaccgaaaacggtaaacggttaaccggtttacccgttttagaaaccgtaaaagtaacggaaaacgtacccgtaaggaaccggaacccggaacggaaccgaacggtactagtacgttaattacgtgtacgaccgtagaacgacgaaggtacgaaggtcggaggacgtacggg

SEQ ID NO: 334736 - DNA, 713 bp, Homo sapiens
  misc_feature: GZ8MTXP02F2RUT.25.38.D05.1.454.CMB.2.raw
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctggttctcttgttgctattttagaggtgtccagtgtgaggtgcaggttggaggagtcgtgggggaggcgttgggtccgacgggcccgggggggttccctggacgtacctctccgtgtcgcacgcctctggattctagttttagcagttattttggatgagtcgtcgggtccgccgacggccccgaggggaacgggcgtgggtggtgggtacgaccaaacgatacgaacgaagagtgggaaggtgaaagaaacttactagtgggaccggtaacttcggtaggtacggggaaacgggggtcccgtaaacgtttaccaacccgtattaccccggtaacccgaaggggaaaacccctaaaccctaaccccaaaaccctaaaccgttacgaacgttaaacttaataccgtaacggaacctaaaagttagtaaagttcggtacgtaggaacgaacgggccggaacggacgtaccgggtctggttaagttcgtttcgtaggtacggaccgaaggtacgtaaccggtaccccgaacttaccgacgtaccggtacccttagtttacgg

SEQ ID NO: 334737 - DNA, 625 bp, Homo sapiens
  misc_feature: GZ8MTXP02IHFAH.25.38.D05.1.454.CMB.2.raw
  modified_base (165)..(165): a, c, t, g, unknown or other
  misc_feature (165)..(165): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagactgtacagtcacgaccggtgctcgatttagtatctgatagttggatttggggagctctgggagaggagcccagcactagaagtcggcggtgtctccattcggtgatcagcactgaacacagaggactcaccatggagtttgggctgagctgggttttccncgttgctcttttaagaggtgtccagtgtcaggtgcagctggtggagtcgtgggggagcgtggtccagcctgggatcctgagactctctgtgcaacntctggatcgccttnagtaacttggcatccacgtggtccnccaggcctccgagggcaagggactaggaggttgggtntacctttttaggnggactagtgagtcggcgtagtagaaataacgtccgtagtcgactacgtcgtccgtacgacgggtcctcttcctacctactaccgacgaagaacgaaaccgtaaaccgaacgtaaacggtaaccggttaccggtttaccgttaacgaaacgtaaagtaacggaaacgtacgtacggaaccggaacccggaaggtaaccgacggtacttaacgtacgttaacgttacgtacgtacggacgaagtaccgacgtaggtacggacggtacggtacggacg

SEQ ID NO: 334738 - DNA, 555 bp, Homo sapiens
  misc_feature: GZ8MTXP02JAIN9.25.38.D05.1.454.CMB.2.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
  modified_base (477)..(477): a, c, t, g, unknown or other
  misc_feature (477)..(477): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacntctggattcgccttcagttaactttggcatccacgtgggtcccnccaggcctccgaggcaagggactaggaggtgggtagtacttttagtgggcagtgatggcnggtnaaataaagcctaatcgacagacctccgtacgaacgggccgcttccnccactcctccagacgacaacgaccaaagaacgtacggttcctttagacaaatgaaacncgagacgaccgagacacggactagtacgtattacgtgtacgacgagaacgccgaaggtcgagacggtaggacgtaggg

SEQ ID NO: 334739 - DNA, 601 bp, Homo sapiens
  misc_feature: GZ8MTXP02JYTPZ.25.38.D05.1.454.CMB.2.raw
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagtattttggatgagcgtgggtccgccacggccccgaggggaacggggctgggtggtggggtacgaccaaacataacgacgaaagatggggaggtagaagtaaaattactagtcggacggactcgtggtaggaaacgggcccgaattcccgaccactctacccgagggaccaacctaccaaacaactacagtatatctagacaaatgaaatgtctagagacgaccggaggacgacggcgtgtagttatttacgtgtcgacggaggacggtaaccggacccccgtaaatcccgagtaccggaacccttagtttcgg

SEQ ID NO: 334740 - DNA, 600 bp, Homo sapiens
  misc_feature: GZ8MTXP02JHGLN.25.38.D05.1.454.CMB.2.raw
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgcttattttagaaggtgtccagtgtgaggtgcaggttggaggagtcgtgggggaggcttggtccgaggccggggggtccctgagactctcctgtgcagcctctggattcagttttagcagtattttggatgagctggtccgccacggcccccaggggaacggggctgggtggtggggtagaccgtaaacagtacgacgaagacgttagggaggtagagaaaatacgtagtgacgggaactcgtagtaggaacggggcccgaattccgacctacgtctaccgacgggacaacctaccaaacaacacagttactatctagactaaagngaaagttggtacnggaagaggaccggaaggacgacggtctgtagttattcgtgtcgacggagtagtccggaccccctaagtaccagtaccgtacccgttaattcg

SEQ ID NO: 334741 - DNA, 570 bp, Homo sapiens
  misc_feature: GZ8MTXP02JEEW2.25.38.D05.1.454.CMB.2.raw
  modified_base (418)..(418): a, c, t, g, unknown or other
  misc_feature (418)..(418): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagtagttatttttacagtctaccaaacaataaggtacttcttagcttggtatcagcagaaaccaggcagcctctaagctagctcatgtacgtgggcgtccgtaacccgggatccccggtcgtccgtcgaccgtatcgaggtcggggcgggtcgggtcgtgggactaggtacttcgactctacacctatccancctagccctgcaggctaggaaatgtggtggacttaggtttaatctggtacagtactaattagtactaactcgttaccggtctaccggttcgggacggtaccgggtaactagggtaggaatacgtacgaacggaccgaattcgggtcggtaac

SEQ ID NO: 334742 - DNA, 611 bp, Homo sapiens
  misc_feature: GZ8MTXP02H9E9O.25.38.D05.1.454.CMB.2.raw
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctctgggcgagagggccaccatcaactgcaagtccagccagagttatttttacagctaccaacaataaggacttcttagcttggtatcagcaagaaaccgagggcaggcctctaagctgctcatgtacgtgggcgtccgtaacccggggaatccccggtgtcccctagaccgtattcgagtggggccggtcgggtcgtgggactaggtactttcccgaacccttcaaccctatccaagccacgtcctaggccaagggtctagaaacgtgttcggtggtacttagtttactacgtcgtacagtactaattattaactacgttaacgttccggtcttaaccggtttcggggaccgggtacgggtaaccgaacggggttggaacgtaacgtacgaaaggtaacgtaacgtggtacggtaccgtccgg

SEQ ID NO: 334743 - DNA, 572 bp, Homo sapiens
  misc_feature: GZ8MTXP02IU329.25.38.D05.1.454.CMB.2.raw
  modified_base (304)..(304): a, c, t, g, unknown or other
  misc_feature (304)..(304): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtgggcgagagggccaccatcaactgacaagtccagccagtagtttatttttacagtctaccaaacaataaggtacttacttaagtcttaggtaatcacgacaacgaaacccgngggacagccctctaagctgctcatgtacgtcgggtctaccgtaaccgggtatccccggtacgtcccgtgaccgtattcgaggtcggggcgggcgggtcgtaggacctagtactttcactctacacatcagcacgctgctaggctagacgtatggtcgtacttagtttactacgtgtacagtactaattagtactacgttacgtcgtataccgttcggacggtaccggacgtaggtagaagtacgtacgaagtacgagtcgtacgtacg

SEQ ID NO: 334744 - DNA, 628 bp, Homo sapiens
  misc_feature: GZ8MTXP02F65AP.25.38.D05.1.454.CMB.2.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggactccctgagctctcctgtcgcaacntcnggattcgccttnagttactttggcntccacgtcggtccncaggcctcgaggccaaagggctaggacggtgggtatactttttagtcggggactagtcgtagtcggactaggggtaanaaagttaaacgtcctagtcgactagtacccgtaccgtacggacggtccctcttccctactacgtcctaccgaacgaacgaaccgaaaccgaaccgtaaaggtaaccggttaccgtttacttaacgaaactaaacgtaacgtaaacgccgtaacggaccgaccggacgacgtacgtactagtacgttactacgtacgacgacgacggaacgtacgaggtacggtacgaggtcggacgtacgg

SEQ ID NO: 334745 - DNA, 539 bp, Homo sapiens
  misc_feature: GZ8MTXP02FR8VF.25.38.D05.1.454.CMB.2.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (319)..(319): a, c, t, g, unknown or other
  misc_feature (319)..(319): n is a, c, g, or t
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
  modified_base (529)..(539): a, c, t, g, unknown or other
  misc_feature (529)..(539): n is a, c, g, or t
tcagactgtacagtcacgaccggtgctcgatttagtatctgatagttgggtttggtggtctccactcccgcccagtctgtgctgtctcagccaccctcagtgtctggggccccccgggcagagggtcgacatctcttgttctggaagtcgctccaacgtcggcagtaatagtgtaagctggtaccagcaactcccaggaacgccccanactcctnatgtatgggaatgatcagcgcccctgaggggtccctgaccgattctctgccctccacgtctggcacctcagccctccctggccagtcccggtggcctccaatcngaggatggaggccgtaatttattattgtgcaggcgtgggatgaacaggtaagtacggttatgtcgttacggaattcggggaaccaagggtcctaaccgttcccgtaggtcacggaccccgaacggccccaaaacccccnttcgaccacctctccgttccccnccctctccactcgacagttcgnggcggcggcncggacacggcanatgnnnnnnnnnnn

SEQ ID NO: 334746 - DNA, 581 bp, Homo sapiens
  misc_feature: GZ8MTXP02H1MWP.25.38.D05.1.454.CMB.2.raw
  modified_base (119)..(119): a, c, t, g, unknown or other
  misc_feature (119)..(119): n is a, c, g, or t
  modified_base (212)..(212): a, c, t, g, unknown or other
  misc_feature (212)..(212): n is a, c, g, or t
  modified_base (564)..(564): a, c, t, g, unknown or other
  misc_feature (564)..(564): n is a, c, g, or t
  modified_base (570)..(581): a, c, t, g, unknown or other
  misc_feature (570)..(581): n is a, c, g, or t
tcagactgtacagtcacgaccggtgctcgatttagtatctgatagttgggtttggtggtctccactcccgcccagtctgtgctgtctcagccaccctcagtgtctggggccccccgggnagagggtcgacatctcttgttctggaagtcgctccaacgtcggcagtaatagtgtaagctggtaccagcaactcccaggaaccggccccccanactcctcatgtatgggaatgatcagccgcccctgacggggtccctgaccgtattcctctgccctccacgtctcggcacctcacgccctcccgtggccacgtccggtggcctaccaatcgtaggaggatggacggtccgtaatttattagttgtgaccgagtcggtagggactagaacggaagggaaacgtacgggtttatcggttcgttacggaagttcggggaacctaaggtcccacggtccgtaggtcaacgacccgaacggaccccaaccccatcgcctaactccttcccgttccccacccctcctacacttacgtactagtcctgacggcggcgtggacaacggccanagtagnnnnnnnnnnnn

SEQ ID NO: 334747 - DNA, 701 bp, Homo sapiens
  misc_feature: GZ8MTXP02H403E.25.38.D05.1.454.CMB.2.raw
  modified_base (404)..(404): a, c, t, g, unknown or other
  misc_feature (404)..(404): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggactcctgagctctcctgtgcaacatcgtggattccgcttcaagttacttggctatccacgtgggtcccgccaggcctaccgagggacccaaaggggtactaggacgggttgggtacgtacttttttagtggggcctagtagggtaattggggactaggggttanaaacgtaaacgtcccttaagtcgacgtaacggacccttcccgtacggaaacggggtcccgtccttacccgttacccactcctaccgaaagacgaaaccgaaccgaccgtaaacggtaaacggtacccggtttacctttacggaacctaaaagtacggaaaacgtcccgtaaggaacccgaccggaaacgggaaccgacggggtaccttaagttacggttaaacttaaacggttcggacggtacgaacgggttaacgaccggtaaggtacgggaaggagggttcggacggtaacgggg

SEQ ID NO: 334748 - DNA, 672 bp, Homo sapiens
  misc_feature: GZ8MTXP02H3GPP.25.38.D05.1.454.CMB.2.raw
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (440)..(440): a, c, t, g, unknown or other
  misc_feature (440)..(440): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcacatggagtttgggctgagctgggttttcctcgttgcttcttttaagaggtgtccagtgtcaggtgcagctggtggagtcgtgggggagcgtggtccagccgtgggatccctgacgctctcctgngacaanatcgtggattccgccttcacgttaactttcggcatccctacgtcgggtcccgcccgaggcctccgaggacgaagggactaggnggttggggtattactttttagtggggctagtggatggacnggtgaaataaacggctagtcgccaacgtaccgtccggacgtaacggggtcccncctttcccgtcctaacttcccgtaacccgaacgacgaaacccaaaccggaaccgtaaaaggtaacggttacccgggtttacccttttaaggaaacctaaaacgtagaaaaacggttccgaagaaccggaacccggaaacggacccgtaacgggtactttaagttacgttaacttaacgtgtacgacggtagaaccgacgttaacggcggaacggacggttcggaacgtcggg

SEQ ID NO: 334749 - DNA, 632 bp, Homo sapiens
  misc_feature: GZ8MTXP02H0ABH.25.38.D05.1.454.CMB.2.raw
tcagactgtacagtcacgaccggtgctcgatttagtatctgatagttgggtttggggaggtctcagagaggagccttagccctggactccaaggcctttccacctggtgatcagcactgagcacagaggactcaccatggaattggggctgagctgggttctccttgttgcttattttagaaggtgtccagtgtgaggtgcaggttggaggagtcgtgggggaggtcgttggtccgagggccgggggtccctggacgactctcctgtgcagcctctggattctagtttagctagtatttggatgagtcgtcgggtccgccgacggaccccgaggggaacgggtcgtgggtggtagggtacaccgaagaagtaacgaacgaacggagtagggaggtagaagtaaatactagtcggacgtactcgtaggtacggaacggcgtatcactgtccacgaaggacaacctacaaacgaactcgaattaactctacgtagaaactaaagtagtaaagttggctaaggacggaacgaccgggaaggaacgtccgggtacgttgtttagttacgtttcggtagttcggacgtaggtaccgaaccgacccgtaactccaagtaccgtaccttaaggtttccg

SEQ ID NO: 334750 - DNA, 655 bp, Homo sapiens
  misc_feature: GZ8MTXP02IDARS.25.38.D05.1.454.CMB.2.raw
  modified_base (511)..(511): a, c, t, g, unknown or other
  misc_feature (511)..(511): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctagtggggacatcgtgatcgaccagtctccacgacctcctggctgtgtctcgtgggcgaggacgggccaccatacaactgcaacgtccagccagtagtttattttacatcctacaaactaagtaagtacttacgttagtcgttaggtactacgaacgacaaacggaaaccgacgggaccacgtacccctaccgtaaaggcttcgtactctagtcggtacggtcgggtaccgttacccgtaaccgggtactccccggtaccgtcccgtacgtaccgtagttcgtacggtcggggaccggtcgggtacgtcgggtacctaagtctttaccgaccttcgacccaagcgtagacgcgacgtcgcgacgtacggntaaggaagtgtaggtatacttacgttatacgtatacatacttaaattacttacgtacttaccggtcgttacggttacgggtaccgggacgggtaccggaacgtaggtacgaagtaacgaacgtaaggtacgtcggtggtactcg

SEQ ID NO: 334751 - DNA, 787 bp, Homo sapiens
  misc_feature: GZ8MTXP02F31FJ.25.38.D05.1.454.CMB.2.raw
  modified_base (283)..(283): a, c, t, g, unknown or other
  misc_feature (283)..(283): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagcgtgggtggagtcggtgggggaggtcgtggtccagtccgtagggaacgtcccgtagacgtcctcgtccgtgtgacaacntcgtggtacttccgtccctttacgaacgtttaacgtttcggacctactcccgacggttcgggtacccgccgtacggtcctaccggaaggaccgaaaggggtacttaagggacggttggggttacgtttacgttttaggtcgggtacagttggagttcggatagggtaacgaaattaaaacggtccttaagtacgaccgtaacgtaccgttacccggtaaccggtaaccggggtcccttccgttccctaccctacgttacccgaaccgaacgaaaccgaaccgaaaacccggaacgtaaaaccggtaaccgttaacccggtttaccgttttaacggaaaaccttaaaacggtaaacggtaaaacgtaccggtaacggaacccggaacccgggaaacgtacccggtaaacggtccttaaagttacgtttaaacgttccggtacggtacggaccggaacggaacggtaccgtaaggtacggaacggtaggtacggacggtaccgggg

SEQ ID NO: 334752 - DNA, 772 bp, Homo sapiens
  misc_feature: GZ8MTXP02HOJY3.25.38.D05.1.454.CMB.2.raw
  modified_base (344)..(344): a, c, t, g, unknown or other
  misc_feature (344)..(344): n is a, c, g, or t
  modified_base (437)..(437): a, c, t, g, unknown or other
  misc_feature (437)..(437): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagcgtggtggagtcggtgggggaggtcggtcggtccgaggtccgtaggggaactcccgtagacgtacctctccgtgtgacaacatcgtggtacttccgtccttacagttaacgtttggactactcccgacgtcggggtcccncgaggtcctaccggaggacgaaacggggacgtaggtaggttggggtactttacgttttacggtcgggactagtggtacgtgggactagggtanaaaacgtaaacgtccgttaagtcgacgtacggacccgttaccggtaccgtaaccggggtcctacctttcccgtacctacttccgtaaccgaacggaaccgaaccgaaaccgaccgtaaacggtaaaccggtttccggtttaccgtttacggaaacttaaacgtaacggaaaacgtcccgtaacgggaacccgaaccgggtaacgaacccggtaccgggtaacgttaacgttacggttaaaacgtttccggtaggttaccggaacggaacgggtaaccgttcccggaaagggtttacggaaaggggtttacgggacgggttacggttaaccggggg

SEQ ID NO: 334753 - DNA, 598 bp, Homo sapiens
  misc_feature: GZ8MTXP02I5ORB.25.38.D05.1.454.CMB.2.raw
  modified_base (270)..(270): a, c, t, g, unknown or other
  misc_feature (270)..(270): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcttgggttttcctcgttgcttctttttaagaggtgtccagtgtcaggtgcagctgggtggagtcgtgggggagcgtggtccagcctagggaactcctgagtctctcctgtgacaacntctggtattccgccttacgtagttaacgtttcggactacttcccgacgtttcgggcccgccgaggcctaccgaggtacgaaggggtactagggacgtggggtntactttttaggnggactagtgacgtggacaggtanaaactaaacgtcctagcgactaacgaccgtcgacgaacgtcctactcctcactaccgacgagacgaacaacgacctaaaggacgtaccgttcttacgaacaaagtaacgaacgacgtacgacgaccgacgacgacgtactatacgtactacgtacgtacgacgagaacgacgacgagaggagtgacgacg

SEQ ID NO: 334754 - DNA, 648 bp, Homo sapiens
  misc_feature: GZ8MTXP02IUK4D.25.38.D05.1.454.CMB.2.raw
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
  modified_base (516)..(516): a, c, t, g, unknown or other
  misc_feature (516)..(516): n is a, c, g, or t
tcagactgtacagtcacgaccggtgctcgatttagtatctgatagttgggtttgggggagctacaacaggcaggcagggggcagcaagatggtgttgcagacccaggtcctcatttctctgttgctctggatctctggtgcctatggggacatcgtgatgacccagtctccagactccctgctgtgtctcgtggcgagagggccaccatcaactgacaacgtccagaccagtagttatttttacagtctaccaaactaataaaggacttacttagcttaggtatcagacaagaaaccgagggacacggtaccctaccgtaaagcctggtacctcgtaagttcgtaacgtcggggtccgtacccgtaaccccggggaaatttccccccggtacgttacccccgaggaaccgtattacggagtcgggggccgggcggggtccgtaggggaccaaggttactttacnccttactccaaacctatcacgacncgtaccncgacgagtacgtagaaacgtntaggtggtacttacggtttatacgttgtactagaactaataattacgtaacttacgcgttacgtacgttccggacgggtacggaaccgtaggtaacgggaatacgtacaaggaacgtaacgtggacgtaccg

SEQ ID NO: 334755 - DNA, 578 bp, Homo sapiens
  misc_feature: GZ8MTXP02JJYYB.25.38.D05.1.454.CMB.2.raw
  modified_base (291)..(291): a, c, t, g, unknown or other
  misc_feature (291)..(291): n is a, c, g, or t
  modified_base (492)..(492): a, c, t, g, unknown or other
  misc_feature (492)..(492): n is a, c, g, or t
tcagactgtacagtcacgaccggtgctcgatttagtatctgatagttgggtttgggggagctacaacaggcaggcaggggcagcaagatggtgttgcagacccaggtcctcatttctctgttgctctggatctctggtgcctatggggacatcgtgatgacccagtctccagactccctggctgtgtctcgtggcgagagggccaccatcaactgcaaagtccagccagtagttatttttacagcctacaaacaataaggacttctagtacttgtaactcagcaggaaccngggtacacggcccttacaagctgcttacacgttgaactcgggtacgtccgtaaacccgggatccccgggtctcccgtagtacccggtatttccgaggtcggggccggtaacgggtctcggggaactagtacgtttcatcctacgcccatcaagtcacgctcgcagctagtagagtgtgctagttattactcgtatacgtanatatactacttaactcgttacgtacgttcggtacggacggtacgaacgtagtaacgagttacgtacgacgtaacgttacggtcgcg

SEQ ID NO: 334756 - DNA, 551 bp, Homo sapiens
  misc_feature: GZ8MTXP02H9ZY5.25.38.D05.1.454.CMB.2.raw
  modified_base (164)..(164): a, c, t, g, unknown or other
  misc_feature (164)..(164): n is a, c, g, or t
  modified_base (184)..(184): a, c, t, g, unknown or other
  misc_feature (184)..(184): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (254)..(255): a, c, t, g, unknown or other
  misc_feature (254)..(255): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
  modified_base (460)..(460): a, c, t, g, unknown or other
  misc_feature (460)..(460): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagcgtggttttcncgttagctctttaagaggtntcagtgtcaggtgcagctggtggagtcgtgggggagcgtgccagctgggactcctganctntcngtncanncngactcgctcagttacttgntatccagtcgggtcncaggctccgaggacaaggataggagttgggtacttacttttagtgggacntaggtatcggatgtagaaactaagctancgactacgacctcgacgacgtcctactcctctactcacgagactaacgaactacgaaggtacgttacgtttactagaactaaagacgaacncgtacggacggaccgaagtacgtcgtaacttgtaacttacgtacgtacgcgacgacgaacgacgacgtacgaggtacggacgtacgtacgg

SEQ ID NO: 334757 - DNA, 652 bp, Homo sapiens
  misc_feature: GZ8MTXP02FOFM2.25.38.D05.1.454.CMB.2.raw
  modified_base (371)..(371): a, c, t, g, unknown or other
  misc_feature (371)..(371): n is a, c, g, or t
tcagactgtacagtcacgaccggtgctcgatttagtatctgatagttgggtttggggagctctgggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagttatggcttcgtctgggtcctccagtgtccaggcaaggggctgggagtggctggggattacgtggtccctgacagaacaaatgaacntatcacgcgagtcggtggacggggcgatacgacactctcgaggacaattaccaagacaaccctactactactagactaaaacgtacgaaaactaacgttaggtacgaaggtaccggaaggtaacgtaaccgggttaccgttttaaacgtttaccgttaggtacggtacccgtaacccgtacccggtaacgggtaacggttagggtaaccggttaaacggggtaaaaaacggttccggttaaaggtttacccgttaaacccgttaccgttttaacccccggg

SEQ ID NO: 334758 - DNA, 768 bp, Homo sapiens
  misc_feature: GZ8MTXP02FTADA.25.38.D05.1.454.CMB.2.raw
  modified_base (270)..(270): a, c, t, g, unknown or other
  misc_feature (270)..(270): n is a, c, g, or t
  modified_base (320)..(320): a, c, t, g, unknown or other
  misc_feature (320)..(320): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagctgggtttttcctcgttgcttcttttaagaggtgtccagtgtcaggtgcagctggtggagtcgtgggggagcgtggtccagcctgggaagtccctagacgactctcctgtgcaaacntcgtggtattccgccttcagttaactttggctatcccacgtcgggtcccnccgaggcctaccgaggcgaaaggggactaggaggttggggtactacgtttttagtggggacagttggaagtgggactaggtacgaaataaaacgtcctaaagtcggactaacgtaacccgtacccggtaccggtaaacggggtcccgtacctttcccgtaccctacttacccgttacccgaacggaaacgaaccgaaacccgaaccccgtaaaaacgggtaaaccgggtaacccgggtttacccgtttttacggaaaccgtaaaacgttaaccgggtaaaaacgtcccggttaacggaaccggaaaccccgggtaacgggaacctaccgggggtaacttaaccggttacgttaaactttaaccggttagggttaccggacggtaaacggaaccggtaacccggtaacggttaaggaacggtacgggtacgggtacggtaaaccggggg

SEQ ID NO: 334759 - DNA, 598 bp, Homo sapiens
  misc_feature: GZ8MTXP02GMINS.25.38.D05.1.454.CMB.2.raw
  modified_base (312)..(312): a, c, t, g, unknown or other
  misc_feature (312)..(312): n is a, c, g, or t
  modified_base (548)..(548): a, c, t, g, unknown or other
  misc_feature (548)..(548): n is a, c, g, or t
  modified_base (586)..(586): a, c, t, g, unknown or other
  misc_feature (586)..(586): n is a, c, g, or t
tcagactgtacagtcacgaccggtgctcgatttagtatctgatagttgggtttggggagctctgggagaggagcccagcactagaagtcggcggtgtctccattcggtgatcagcactgaacacagaggactcaccatggagtttgggctgagtcttgggttttcctcgttgcttcttttaagaggtgtccagtgtcaggtgcagctggtggagtcgtggggagtcgtggtccagccgtggaagtccctgagactctcctgtcgcaacatctggattcgccttcagttactttggcatccacgtcgggtccncgaggcctccgaggaccaaaggggactaggtaggtgggtacttactttttagtgggactaagtcgtaagttcggataggtgaaattaaaacggcccttaaagtcgactacgtactccggtacaacggggtcctcttactccgaattcctacgaagacgaacaacgaccaaagacgtaccgttacgtttagaacctaaatagaaacgtcaaggacgaacccgaggacacggacttancgttattacgtgtcgagacgaacgacgaagtgaacggngtcggactcggg

SEQ ID NO: 334760 - DNA, 501 bp, Homo sapiens
  misc_feature: GZ8MTXP01BI9W4.52.1.A01.1.454.CMB.2.raw
  modified_base (218)..(218): a, c, t, g, unknown or other
  misc_feature (218)..(218): n is a, c, g, or t
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
  modified_base (497)..(497): a, c, t, g, unknown or other
  misc_feature (497)..(497): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatccctccctgtccgcatctgtagagacagagtcatcatcacttgccggnaagtcagagcattagaacgtattaaatggtatcaaacagaaaccaggaaacgcccctagaaacctcctgatctatgttcatccatttgctgagtgggtccatcaggtcagtgcagtgatcgtgggacagatcactctcacatcaacngtctgcaggctgaggtattttgactaactttacttctagtacaacnggtattacgactttcccactactttccggcccttggaccagttagtaggattacttcaaacggtaactggtcgctacgactaaccngttc

SEQ ID NO: 334761 - DNA, 505 bp, Homo sapiens
  misc_feature: GZ8MTXP01CWVW8.52.1.A01.1.454.CMB.2.raw
  modified_base (326)..(327): a, c, t, g, unknown or other
  misc_feature (326)..(327): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggcaagtcagagcattagaacgttattaaatggtaaccaacgaaacaggaaacgccctagaactcctgatctatgtcatcctacttgctgagtgggtccatcaagttcagtggnngtgatcgtgggcagaattcactctacacatcacagtctgcaggctgagtatttgactaacttacttctggtacaactagtacgttactacgttccctctaccttcggtccctggacctagtaagtgatacacgtaaacgtcttagttggctgccaacctatcttacgtccttctaacc

SEQ ID NO: 334762 - DNA, 552 bp, Homo sapiens
  misc_feature: GZ8MTXP01BM6SL.52.1.A01.1.454.CMB.2.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (483)..(483): a, c, t, g, unknown or other
  misc_feature (483)..(483): n is a, c, g, or t
tcagcgcagtacgacacgaccggtgctcgatttagacgtctcatcaggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactcatcagcagtgtatactggctggtcgcacgccccgagggaagggttgagtggagttgggagtatcgatcacgagtgggagcacctacctgaacccgtcctcacgacctcgagtcgccataactcaacagacacgtaccaagaccagttacacctgacggctagaactcgtagtcgaccgccgacaacgaccacgggccttattagttagttgtcgcgtcgggtacttcggaagggggtgtaagtagtaggtgcctaaggnttcggttatcgttcccttgcttacggtggggccaacggggtacccctgggttcctaaccgttcgtcccg

SEQ ID NO: 334763 - DNA, 519 bp, Homo sapiens
  misc_feature: GZ8MTXP01DQLMX.52.1.A01.1.454.CMB.2.raw
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (503)..(503): a, c, t, g, unknown or other
  misc_feature (503)..(503): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcatagaacgtattaaatggtacaacgaaacaggaaanccctgaactcctgatctatgttcatccatttgctgagtgggtccatcaaggttcagtggnagtggatcgtgggaacagaaattcactctcacatcacagtcngnagctgtagtattgactaacttacttctacgtacaacgtagtacgttacctacgttccctacgttaccgttccggtcccgtaggacctaagtaaggtagaatacttaacgaaacgtacttggttcgctcgacctaactntcttcttccttctaac

SEQ ID NO: 334764 - DNA, 513 bp, Homo sapiens
  misc_feature: GZ8MTXP01BJZHB.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (459)..(459): a, c, t, g, unknown or other
  misc_feature (459)..(459): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactcatcagcagtgtatactggctggtcgcagccccgagggaagggttgagtggattgggagtatcgatcacagtgggagcacctacctgaacccgtcctcacgacctcgagtcgccataatcaacagacacgtcaagaccagttctacctgaggctagaactctagtcgaccgccgcagacacggtccgtagtattattgtgcgcggcttcgagggggtgagtagtagtggctacgnttcgttatctccttgcttacgtggggccaagggaccctgggactccgttctccc

SEQ ID NO: 334765 - DNA, 502 bp, Homo sapiens
  misc_feature: GZ8MTXP01DQ9N2.52.1.A01.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (489)..(489): a, c, t, g, unknown or other
  misc_feature (489)..(489): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagatcatcatcacttgccggnaagtcagancatagactattaatgacaanagaacaggaancctnactctnatctatgtcatcattgctgagtggtccatcagttccagtgcagtgaatcgtgggacagaattcactctcaccatcaccagtctgcgaggctgagtatttgactaactttacttctacgtacaaacgagtagttactacgtttccctactacgtttccggcccgtgggacctaagtaggttggaattagtaacaaacgttaacgttggttacggctagccaacctnttcttcgttcttc

SEQ ID NO: 334766 - DNA, 521 bp, Homo sapiens
  misc_feature: GZ8MTXP01EG6SP.52.1.A01.1.454.CMB.2.raw
  modified_base (215)..(215): a, c, t, g, unknown or other
  misc_feature (215)..(215): n is a, c, g, or t
  modified_base (421)..(421): a, c, t, g, unknown or other
  misc_feature (421)..(421): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggnaagtcagagcattagaacgtattaaatggtacaacagaaaccagggaaagccctgaactcctgatctatggtcatcactttgctgagtgggtccatcaaggttccagtggcagtggaatctgggacagaaattcactctcaccatcaccagtctgcaggctgaggtatttgactaactttacttctgttacaaacagtacgttacncgtttccctactacctttccggcccttggggacccaagttagaggtattaaacgtaacgtaaacgttacgttggttcgctgcactacttctcgttcgttc

SEQ ID NO: 334767 - DNA, 518 bp, Homo sapiens
  misc_feature: GZ8MTXP01BZZSJ.52.1.A01.1.454.CMB.2.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagcattagaacgtattaaatgtacaanagaacaggaacnccctgaactctgatctatgttcatccatttgctgagtgggtcccatcgaggttccagtgcagtggaatcgtgggacagattcactctcaccatcaccagtctgcaggctgaggtatttgactaacttcttctgtacaactagtaagtttaccacgtttcccctacttaccgtttccggcccgtaggggaaccctaagttaggttggtaattacgtacgaaacgttacgttgttaggctgctacattctgttctttc

SEQ ID NO: 334768 - DNA, 523 bp, Homo sapiens
  misc_feature: GZ8MTXP01DO8WV.52.1.A01.1.454.CMB.2.raw
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (397)..(397): a, c, t, g, unknown or other
  misc_feature (397)..(397): n is a, c, g, or t
  modified_base (510)..(510): a, c, t, g, unknown or other
  misc_feature (510)..(510): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggnaagtcagagcattagactattaatgacaanagaacaggaanccctgaactctgatctatgtcatcatttgctgagtcggtccagtcgaaggttccaggtggcagtggaatcgtgggactagtacttcactctacaccatcaccagtctgcaggtctagaggtatttgactaactttccttntagtacaaactgtaacgttaccacgtttccctaacgtcgtttccggaccctaggggacctaagtggttacgtattaactaacgaaacgttagttgagggcctagcctaacctnttcttcgttcttc

SEQ ID NO: 334769 - DNA, 522 bp, Homo sapiens
  misc_feature: GZ8MTXP01BJH17.52.1.A01.1.454.CMB.2.raw
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtattaaatgtacaanagaaccaggaaanccctgaactctgatctatggtcatccactttgctgagtgggtccatcaaggttccagtgcagtggaatctgggacagaattcactcncacatcacagtcngnagntgtagtagttagtactacttacttacgtactactaactaacgtacgttacgtacgttacctacctaccgttccgtccgtcggtacgtaagtagttagtagttacgtaactaaacgttaacgttgttacgtcgtcgtctactacttactcgttcgtc

SEQ ID NO: 334770 - DNA, 564 bp, Homo sapiens
  misc_feature: GZ8MTXP01D3KTQ.52.1.A01.1.454.CMB.2.raw
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagcattagaacgtattaaatggtaaccaacagaaaccagggaaacnccctagaactctgatctatggtcatctactttgctgaggtcgggtccatcaaggttccaggtggcagtggaactcgtgggacagtaaattcactctcacctatcaccagtctgctaggctggagtatttgcttaaacttcttctagtactaactagtacgttaactcgtttccctacgtaccgtttcggaccccgtggggtaccctaagttacggttaggtaattaacgtaaccgaaaaccgttaacgttggttacgggtcttacgaacctaacctacttccttcgttcctttcc

SEQ ID NO: 334771 - DNA, 522 bp, Homo sapiens
  misc_feature: GZ8MTXP01BTRAZ.52.1.A01.1.454.CMB.2.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaatggtacaacagaaaccagggaaagcccctgaactcctgatctatggttcatccactttgctgagtggggtccatcaaggttccaggtggcagtggaatcgtgggacagaattcactctcaccatcaccagtctgcaggctgaggtattttgactaactttcttcgtgtactaaacagtagttaccacgtttccctacgtaccgtttccgggccctgggaccctaagttacgttggtaattatacaaacgaacgttggttaggctgcctacattctgttctc

SEQ ID NO: 334772 - DNA, 521 bp, Homo sapiens
  misc_feature: GZ8MTXP01BMT31.52.1.A01.1.454.CMB.2.raw
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagcgcagtacgacacgaccggtgctcgatttagacgtctcatcagggggagtcagtctcagtcaggacgcagcatggacatggagggtccccgctcagctccgtggggctcctgctactctggctccgaggtgccagatgtgtcatccagatcgacccagtctccatccctcctgtccgcatctgtaggagacagagtcatcatcacttggccggcaagtcaagagcaattagaacgttattaaagtggtaaccaaacaagaaaccgagggaaacgcccctagaacctcctgatctatgtcatcatttgctgagtcggtccatcgaagtcagtgcagtgaatcgtggacagattcactctacgaccatcgacagtcngngagtntgagtattgacttacttactcgtagtacaagtagtactactcttcctactccgttccgcctggactaagtagttagtaattacgtaacgaaacgttacgttggttacgctacgaacctactattcttcgttcctc

SEQ ID NO: 334773 - DNA, 551 bp, Homo sapiens
  misc_feature: GZ8MTXP01DPLSY.52.1.A01.1.454.CMB.2.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgtattaaatgtacaanagaacaggaaanccctgaactctgatctatgttcatccactttgctgagtgggtcccagtcaaggttccagtggcagtggaatcgtgggacagtaattcactctcaccatcacagtctgcaggctgaggtatttgactaaactttacttctgtacaaactagtaacgttacctacgtttcccctactaccgtttccggcccgtaggggtaccctaagttacggttggtaattaacgttaccgaaaacgttaaccgttggttacggcccttaggcctaacccattccttcggttcttttccc

SEQ ID NO: 334774 - DNA, 512 bp, Homo sapiens
  misc_feature: GZ8MTXP01D0K0Z.52.1.A01.1.454.CMB.2.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (385)..(385): a, c, t, g, unknown or other
  misc_feature (385)..(385): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggcaagtcagagcattagaacgtattaaatggtaaccaanagaaacaggaaacnccctagaactctgatctatgtcatcactttgctgagtgggtcccagtcaaggttccaggtgcgagtggaatcgtgggacagtaattcactctcacatcaccagtctgcaggctgaggtntttacgctaaactttcttctacgttacaacgtaggtacttactacgttccctctacgtttccggccttgggaccaattagngtattagtacaacgttacgttgttcggctncnctcttctcgttctc

SEQ ID NO: 334775 - DNA, 496 bp, Homo sapiens
  misc_feature: GZ8MTXP01C9HTI.52.1.A01.1.454.CMB.2.raw
  modified_base (246)..(246): a, c, t, g, unknown or other
  misc_feature (246)..(246): n is a, c, g, or t
tcagcgcagtacgacacgaccggtgctcgatttagacgtctcatcaggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtattaaatgtacanagaacaggaagccctgactctgatctatggttcatccactttgcttgagtgggtcccatcaaggttccagtgcagtggaatctgggacagaaattcactctcaccatcacagtctgcaggctgaggtatttgactaacttacttctgttacaaacagagttaccagtttccctacactttcggcccttgggaccaatgttggtaattactacaaaacgacttgaggcctgcaccattcctgttcttaacc

SEQ ID NO: 334776 - DNA, 573 bp, Homo sapiens
  misc_feature: GZ8MTXP01DTYOP.52.1.A01.1.454.CMB.2.raw
  modified_base (218)..(218): a, c, t, g, unknown or other
  misc_feature (218)..(218): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctggtaggagacagagtcatcatcacttgccgggnaagtcagagctattagaacgtattaaatggtaacaanagaacaggaaancccagactctnatctatgtcatcatttgctgagtggtccatcaaggttccaggtgacagtgaatcgtgggacagtaatcactctacaccatcaccagtctgacgaggtctaggaggttatttcgacctaactttacttctagttaaccaagtacgtaagtttacctacgtttcccctacgttaccgtttcccgggtaccctcggggtaacctaagttaacggttggtaaattaactaaaccggtaaaacgttaacgttgggttacggtccgttcgaacctaccgtagttccttcgttcctttaacc

SEQ ID NO: 334777 - DNA, 541 bp, Homo sapiens
  misc_feature: GZ8MTXP01CRCF9.52.1.A01.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (486)..(486): a, c, t, g, unknown or other
  misc_feature (486)..(486): n is a, c, g, or t
  modified_base (512)..(512): a, c, t, g, unknown or other
  misc_feature (512)..(512): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtccgcatctgtagganacagagtcatcatcacttgccggnaagtcagagcattagacgtattaatggtaacaanagaaacaggaaacnccctagaactctgatctatggtcactcctacttgctggacggtcgggtaccctatacgaaggtttccaggttgcgtagtgtaatcgtgggactagtaactcactctacactatcacatctgacaggctaggaggttatttcgactaactttctcgtactacgtaaactagtaacgttactccgttcctactccgtttccgccgtaggacctaatgttacgtanacgtaactaagttaccgttggcgtcncgaactactattcgtaaccttcttaaccc

SEQ ID NO: 334778 - DNA, 651 bp, Homo sapiens
  misc_feature: GZ8MTXP01AL9KC.52.1.A01.1.454.CMB.2.raw
  modified_base (216)..(216): a, c, t, g, unknown or other
  misc_feature (216)..(216): n is a, c, g, or t
  modified_base (362)..(362): a, c, t, g, unknown or other
  misc_feature (362)..(362): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagatcatcatcacttggccgggnaagtcagagctaattagaacgttaatttaaagtggtaaccaaacaagaaaaccgagggaaacgcccctagaacctcctagtatctagtggttacacttacctatttgctggaggtcgggtaccagtcgaaggttccaggtggacgngtgaatcgtgggacagtaattcactctacaacactcaaccagtcgtcgagaggctggtaaggtaattttgacttaactttacttctacgttaacaaactacgttaacgtttaaaccgtaccgtttccccttacgttaacccgttttccgggaccccgttagggggaaccctaaggttaagggttacgggtaaattaaacgttaaaccgaaaaacccggttacgttacgggtttgggaaccgttacgtaacccaaccctaatttacccgggttttcgtttaaccgttccg

SEQ ID NO: 334779 - DNA, 532 bp, Homo sapiens
  misc_feature: GZ8MTXP01ATDJH.52.1.A01.1.454.CMB.2.raw
  modified_base (223)..(223): a, c, t, g, unknown or other
  misc_feature (223)..(223): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttcggagatcatcgtccctcacctgctctgtctctggtnactcatcagcagtgttattactgggcctgggtccggcacgcccccgagggaacgggttgagtggattgggagtagtcgatcacgagtgggagcacctactcgaacccgtcctcacgacctcgagtcgcataactcaacagacacgtaccaaagaccagttcactgagctgaactctgtcgaccgcgcagacacggcctagtattactggtcgcgcgggtcttcggaggggtgtatgtagtggctagttattcgactctccttgccttacgtcggggacctaaggggaccctggcctaaccgttctcccg

SEQ ID NO: 334780 - DNA, 568 bp, Homo sapiens
  misc_feature: GZ8MTXP01AJ7U3.52.1.A01.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtcccgcatctgtagganacagagtcatcatcacttgccggnaagtcagagcattagaacgtattaaatggtatcaacagaaaccgaggaaacgcccctagaactcctagatctatgtcatccatttgctgaggtcgggtccatcaaggttcaggtggacagtggatcgtagggacagtaactcactctacaccatccacagtctgcagctgaggtattttcgacttaactttcttctacgtacaacgagtacgttaccgtacgtttcccctacttaccgtttccgggaaccccgttaggggaccctaagttacggtagggtaacttaacgttaaccgttaaaacggtaacgttgggtaacggtccgttcgaccctaaccgttcgtttccg

SEQ ID NO: 334781 - DNA, 527 bp, Homo sapiens
  misc_feature: GZ8MTXP01BYWV9.52.1.A01.1.454.CMB.2.raw
  modified_base (221)..(221): a, c, t, g, unknown or other
  misc_feature (221)..(221): n is a, c, g, or t
  modified_base (324)..(324): a, c, t, g, unknown or other
  misc_feature (324)..(324): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgtattactggctggtccgcagccccagggaagggttgagtggattgggagtatcgatcacgagtggggagcacctacctgaacccgtccncacgacctcgagtcgccataaatcaacacgacacgtaccaagaaccagttcctacctgagctgaactctgtgaccgccgcagacacggccgtatactttagttgtagcggtcgggctttcgagggggtgtagtataggtgctacggattcgttatctcccttgcttacgtgggcaagggaccctgggttcaaccgttctcccg

SEQ ID NO: 334782 - DNA, 518 bp, Homo sapiens
  misc_feature: GZ8MTXP01EFT7J.52.1.A01.1.454.CMB.2.raw
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (501)..(501): a, c, t, g, unknown or other
  misc_feature (501)..(501): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagancatagaacgtattaaatgtacaacagaacaggaanccctgaactctgatctatgtcatcctactttgctgagtggtccatcaaggttccagtggcagtggaatcgtgggacaagaattcactctacaccatccaacngtcngacgagctaggagttattacgacttaacttacttgtactaacaacgtacgtacttactacgttcccgtactaccgttccggaccgtacggactaagtcgagtaattacgtaacgaaacgttacgttggttcgctancactacttctcgttctc

SEQ ID NO: 334783 - DNA, 577 bp, Homo sapiens
  misc_feature: GZ8MTXP01ASEQ7.52.1.A01.1.454.CMB.2.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtcctccatccctccctgtccgcatctggtaggagacagagtcatcatcacttggccgggcaagtcagagctaattagaacgttatttaaattggtaaccaacaagaaaccagggaaacgcccctagaacctcctgatctatggttcatcctatttgctggtagtggggtacccagtacgaggttccaggtggcaggtgaactcgtgggacagtatcactcacaccatcacagtctgcaggctgaggttatttgactaacttacttcgtgtactaacaggtaacttacctcgtttaccctcttacgtttcccggcccgttacggggccctaagtacggttggtaacttattaaccgaaaagttaccgttggttacgggtcttacggaacctacctactttccgtcgtttctttaacccg

SEQ ID NO: 334784 - DNA, 506 bp, Homo sapiens
  misc_feature: GZ8MTXP01CIX2G.52.1.A01.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (347)..(347): a, c, t, g, unknown or other
  misc_feature (347)..(347): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagancatagaacgtattaaatgtacaanagaacaggaanccctgactcngatctatgtcatccactttgctgagtgggtccatcaaggttccagtgcagtgaatcgtggacagattcactctcacntcacagtctgcaggtctgaggtatttcgactaactttacttcgtgtacaactagtacgttactacgttccctctacgtttccggcccgtgggacctaagtagttggaacttagtaacgaagttacttggttacggctgaacacattctcgttcttaacc

SEQ ID NO: 334785 - DNA, 520 bp, Homo sapiens
  misc_feature: GZ8MTXP01DL5FG.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttcggagatcatgtcccctcacctgctctgtctctggtnactcatcagcagtgtatactggctggtcggcagccccagggaagggttgagtggattgggagtatcgatcacagtgggagcacctactgaacccgtcctcacgacctcgagtcgccataactcaacagacacgtaccaagaaccagtctacctgaggctgaactctgtcgaccgcgcagacacgccgtatattagttgtgcgcgggacttcgaaggggtgtatagtagtggaactagattcgagttctcttagcttacgtggggccaaggggaccctgggttcctaacggttccgtccc

SEQ ID NO: 334786 - DNA, 716 bp, Homo sapiens
  misc_feature: GZ8MTXP01BR93R.52.1.A01.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtagganacagatcatcatcacttgccgganagnaganatatagtaattaattaagtacgaacaanaacgaacgaggaacnccanactcanatctagtcgtacactctattgngtaggtacggtcggtacctagtacgtaagttcgaggtggacgtaggtaggtaacgtacggtaagggaaactaaagttaacttacctactacctaccaacctactaccgaaccgtagtccgtaggacgtaacggttacgtagggttaacggtttactttaccgtaaactttaaaccgttttaccgtttacggttaacgtaaaccgtaaaacgttaacggtttaaaccgtttaacccgttacccggtttccccttaaccggtttacccgggtttaccccggggtaccccggttaacgggtaaaccttaaaggttaacgggttaacgttaaaacttaaacgtaaaaccgtaaaaccggttacggttcggttacggtcctaacgtaaccctaaccgttagttccgtttcgtttcccttaaccg

SEQ ID NO: 334787 - DNA, 622 bp, Homo sapiens
  misc_feature: GZ8MTXP01A61MO.52.1.A01.1.454.CMB.2.raw
  modified_base (222)..(222): a, c, t, g, unknown or other
  misc_feature (222)..(222): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactccatcagcagtgttattacgtggcgtggtccggcacgccccgagggaagggtttgagtggattgggagtatcgatcacagtgggancacctacctcgaacccgtcctacacgacctcgagtcgccataanacaacagacacgtacaagaccagtctacctgacgctagaactcgtgcgacccgcacgacgacgacggtaccgttattaagtttacgttggtcgcgggtaccgggtacgtttaccggtaggggggttagtaagtttaagtagggtcgggtccttaaggttagtttaccggttaacttcccgttccgttacgttacgttaaccggttccgggggaccctaaccgggggtaaccccgttcgggttaccctaacccggttcccttccccgg

SEQ ID NO: 334788 - DNA, 519 bp, Homo sapiens
  misc_feature: GZ8MTXP01DH5YY.52.1.A01.1.454.CMB.2.raw
  modified_base (217)..(217): a, c, t, g, unknown or other
  misc_feature (217)..(217): n is a, c, g, or t
  modified_base (251)..(251): a, c, t, g, unknown or other
  misc_feature (251)..(251): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcattctgtaggagacagagtcatcatcacttgccgggnaagtcagagcattagaacgtattaatggtacaanagaacaggaaagccctgactctgatctatgttcatctactttgctgagtgggtcccagtcaaggttccagtggcagtggaatcgtgggacagaattcactctcacatcacagtctgcaggctgaggtatttgactaacttactttctacgtactaaaccagtacgttacacgtttcccaccttacgtttccggccttgggacctaagtggttaggtacttatacgaaacgttacgttgttacggntagctaaccnttcttcgttcttc

SEQ ID NO: 334789 - DNA, 548 bp, Homo sapiens
  misc_feature: GZ8MTXP01ET8BO.52.1.A01.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (521)..(521): a, c, t, g, unknown or other
  misc_feature (521)..(521): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtccgcatctgtagganacagatcatcatcacttggccgggnaagtcagagctattagaacgtatttaaatggtaaccaacagaaaccagggaaacncccctagaactcctgatctatgttcatcctatttgctgagtgggtcccatcgaagttcagtggcagtgaatcgtgggacagtactcactctacacatcacagtctgcaggtctagaggtatttcgactaacttacttctagtacaaacgagtacgttacctaccgtttccctacgttaccgttcccggacccgtacgggtaacctaagttacggttaggtattaacgtaacaaacgttacgttggcggtngaacctactattctaacgttcttaacc

SEQ ID NO: 334790 - DNA, 548 bp, Homo sapiens
  misc_feature: GZ8MTXP01D7NVZ.52.1.A01.1.454.CMB.2.raw
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
tcagcgcagtacgacacgaccggtgctcgatttagacgtctcatcgaggggggagtcagtctcagtcaggacacagcatggacatggacgggtccccgctcagctccgtggggctcctgctactctggctccgaggtgccagatgtgtcatccagatgacccagtctccatccctccctgtccgcatcgtgtaggagacagagtcatcatcacttggccgggcaagtcagagctaattagaacgttatttaaatggtaaccaanaagaaaccgagggaaacnccctagaactctgatctatgttcatctatttgctgaggtggtccatcaagttcagtggnagtgaatcgtgggacagtattcactctcaccntcactagtctgcagggtctagtaggtatttcgacttaacttctttcgtatacaatacgtagttacctcgttccctacgttaccgttccggacccgtaggaactaagtgagtacttaacgaaacgtaaacgttagttcggttacgtctcgaacctacgtcttcgttcgttccttcc

SEQ ID NO: 334791 - DNA, 521 bp, Homo sapiens
  misc_feature: GZ8MTXP01EEPX2.52.1.A01.1.454.CMB.2.raw
  modified_base (221)..(221): a, c, t, g, unknown or other
  misc_feature (221)..(221): n is a, c, g, or t
  modified_base (467)..(467): a, c, t, g, unknown or other
  misc_feature (467)..(467): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgtattactggctggtcgcagccccgagggaagggttgagtggattgggagtatcgatcacgagtgggagcacctacctcgaaccccgtccctcacgacctcgagtcgccataatcaacagacacgtcaaagaaccagttctaacctgagctgaactctagtgaccgccgcacgacacggccgtattacttattgtgcgcgggtatcggaaggggtgtatagtagtggctacgnttcgttatctcttgccttacgtggggcaacgggaccctggacctcgttctcccg

SEQ ID NO: 334792 - DNA, 550 bp, Homo sapiens
  misc_feature: GZ8MTXP01C22AH.52.1.A01.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagancaattagaacgttatttaaatggtaaccaanagaaaccagggaaacgcccctagaactcctgatctatggttcatccatttgctgagtcgggtcccatcaaggttcaggtggcagtggaatctggganagattcactctcacntcacagtctgcaggctgagtatttgactaacttcttcgtgtacaatagtacgttacctcgtttccctacgtaccgtttccggaccctcggggaaccctaagttacggttaggtaacttacgtaacgtaaaacgttaacgttggttacggtctacgcctacattcgttaacgttcctttaacc

SEQ ID NO: 334793 - DNA, 557 bp, Homo sapiens
  misc_feature: GZ8MTXP01CT1O0.52.1.A01.1.454.CMB.2.raw
  modified_base (222)..(222): a, c, t, g, unknown or other
  misc_feature (222)..(222): n is a, c, g, or t
  modified_base (495)..(495): a, c, t, g, unknown or other
  misc_feature (495)..(495): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcagggagtcgggcccaggactggtgaagccttcggagatcatgtccctcacctgctctgtctctggtnactccatcagctagtgttatactgggcctgggtccgcacgcccccgagggaaggggtttgagtggagttgggagtatcggatcacgaggtgggagcaacctacctcgaaccctccctcaccgacctcggagtcgccataactcaacagacacgtaccaagaaccagtctactgaggctgaactctgtcgaccgccgcgacgacaccggaccgttaagtatttaagttcgtggcgcgggtacttcggagggggtgtaatagtagtggctaacgnttcgttattctcttgacttacggtgggacctaagggaccctgggttcctaaccgttcgtccc

SEQ ID NO: 334794 - DNA, 555 bp, Homo sapiens
  misc_feature: GZ8MTXP01APOWU.52.1.A01.1.454.CMB.2.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (486)..(486): a, c, t, g, unknown or other
  misc_feature (486)..(486): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctnacctgctctgtctctggtnactcatcagcagtgttatacgtggctgggtcgcagccccgagggagggtttgagtggagttgggagtagtcgatcacgagtgggagcaccgtacctcgaacccgtcctcacgacctcgagtcgccataatcaacagaccacgtaccaaacgaacctacgttcctacctgacggctaggaaacctcgtagtcgaccgccgacgacgaccgacggtccgtattatttagtgtcgacggcggactttcggaggggtgatagtgtggntacggttattcgttatctcttgcttacggtcgggaccncgggtacccngggttccaaccggttctcccg

SEQ ID NO: 334795 - DNA, 615 bp, Homo sapiens
  misc_feature: GZ8MTXP01C0D6T.52.1.A01.1.454.CMB.2.raw
  modified_base (221)..(221): a, c, t, g, unknown or other
  misc_feature (221)..(221): n is a, c, g, or t
  modified_base (523)..(523): a, c, t, g, unknown or other
  misc_feature (523)..(523): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcactgctctgtctctggtnactccatcagctagttgttattacgtgggcctgggtccgcacgccccgagggtaagggttgagtggagttgggagtatcgatcacgagtgggagcctacccgtacctcgaaccccgtccctcaccgacctcgacgtcgacccataactacaacacgacacgtaccaagaacctagtctacctgacgctagaacctcgtagtcgaccgccgcaacgaccgacgggaccgttaattatttaagttgacggtcggaccgggtacttcggaagggggtgtaagtagtaggtggaacttaacggttntttacggttacttcttccgttagttaccgttaacggttcgggggacccgtaacggggtaaccctcgggttcccgtaacccgttcgttccccg

SEQ ID NO: 334796 - DNA, 527 bp, Homo sapiens
  misc_feature: GZ8MTXP01BKSDF.52.1.A01.1.454.CMB.2.raw
  modified_base (222)..(222): a, c, t, g, unknown or other
  misc_feature (222)..(222): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactcatcagcagtgtatactggctggtccgcacgccccgagggaagggttgagtggattgggagtatcgatcacagtgggagcacctacctcgaaccccgtcctcacgacctcgagtcgccataactcaacagaccacgtccaaagaaccagttactacctgacggctgaactctgtcgaccgccgcagacacggcctatattattgtgcgcggacttcgaggggttgatagtagtggctacggttattcgttattctcgttgacttacgtgggccaacgggacccgtggttcctccgttctccc

SEQ ID NO: 334797 - DNA, 509 bp, Homo sapiens
  misc_feature: GZ8MTXP01AG9FS.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (450)..(450): a, c, t, g, unknown or other
  misc_feature (450)..(450): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactcatcagcagtgtatactggctggtcgcagccccagggaagggtttgagtggattgggagtatcgatcacagtgggagcacctacctgaacccgtcctcacgacctcgagtcgccataatcaacagacacgtcaagaccagtctacctgaggctgaactctgtcgaccgccgcagacacggccgtatattatgtgcgcggacttcgaggggtgatagtagtgctagnttcgactccccgtgcgttcgttgggccagggaaccctgggtcaccgtcttccgtaaccg

SEQ ID NO: 334798 - DNA, 606 bp, Homo sapiens
  misc_feature: GZ8MTXP01CL9KL.52.1.A01.1.454.CMB.2.raw
  modified_base (259)..(259): a, c, t, g, unknown or other
  misc_feature (259)..(259): n is a, c, g, or t
  modified_base (356)..(356): a, c, t, g, unknown or other
  misc_feature (356)..(356): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcaatcacttggccgggcaagtcagagctattagaacgtatttaaatggtatcaanagaaaccgaaggaacgcccctagaaactcctagatctaatggttcattcctatttgctgaggtggggtccatcgaaggttcagtggcagtggatcgngggacagaattcactctcacatcaccagtctgctaggctgtaggtattttgactaacgtttacttctacgtactaaacgagtaacgtttaccacgtttccccttacgtaaccgttttcccggggaaccccgttcggggttaaccccgtaaagttacgggttaacgggtaacttaaccggttacgttaaaaacccggtaaacttcggggttaacgggtcccgttagacccgtaaccgttaacgttttcccg

SEQ ID NO: 334799 - DNA, 508 bp, Homo sapiens
  misc_feature: GZ8MTXP01CA5E6.52.1.A01.1.454.CMB.2.raw
  modified_base (262)..(262): a, c, t, g, unknown or other
  misc_feature (262)..(262): n is a, c, g, or t
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcatagaacgtattaaatggtacaacagaaccaggaaacnccctgaactcctgatctatgttcatccatttgctgagtgggtccatcagttcagtgcagtgaatcgtggacagaattcactcncaccatcacagtctgcaggctgaggtatttgctaacttacttgtgtacaacagtagttaccncgttccctcgtacctttccgggccctgggaccctaatacggttggtaattagtaccaaacgttaacgttggttcggctgaacctaccattctcgttccttc

SEQ ID NO: 334800 - DNA, 504 bp, Homo sapiens
  misc_feature: GZ8MTXP01DEWNI.52.1.A01.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (489)..(489): a, c, t, g, unknown or other
  misc_feature (489)..(489): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccggnaagtcagagcatagacgtattaatgtacanagaacaggaaanccctagactctgatctatgtcatcattgctgagtgggtccatcaagttccagtgcagtgaatctgggacagatcactctcacatcacagtctgcaggctagaggtatttgactaactttacttcgtagtacaaactgtaattacacgtttccctactacgtttccggcccgtgggaacctaatcggttagtattacgtacaaacgttaacgttggttacggtctgcctaactnttctcgttcttaacc

SEQ ID NO: 334801 - DNA, 578 bp, Homo sapiens
  misc_feature: GZ8MTXP01EV2G6.52.1.A01.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
tcagcgcagtacgacacgaccggtgctcgatttagacgtctcatcaggggggcaggagtcagtctcagtcaggacacagcatggacatgagggtccccgctcagctccgtggggctcctgctactctggctccgaggtgccagatgtgtcatccagatcgacccagtctccatccctccctgtccgcatctgtagganacagagtcatcatcacgttgccgggnaagtcagagcattagaacgtaatttaaatggtatacaacaagaaaccgaggaaacgcccctagaactcctgatctatgtcatcctatttgntgaggtcgggtccagtcgtaaggtcaggtgacaggtgatcgtagggactagtactcactctacaccatcacagttcngcaggtctaggtaggttattttcgacttaaactttcttctacgtacaaacgtagtaagttacctcgttcccctacgtacccgtttcccgggcccgttagggaccctaagttacggtggtaacttaacgttaccttaaaacggtaacgtggttcgggacccttggaccctaaccgttaacgtttccg

SEQ ID NO: 334802 - DNA, 560 bp, Homo sapiens
  misc_feature: GZ8MTXP01CF9I9.52.1.A01.1.454.CMB.2.raw
  modified_base (181)..(181): a, c, t, g, unknown or other
  misc_feature (181)..(181): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (435)..(435): a, c, t, g, unknown or other
  misc_feature (435)..(435): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtcccgnatctgtaggagacagagtcatcatcacttggccgggcaagtcagagctattagaacgttattaatggtaacaanaagaaaccgaggaaacnccctagaactctgatctatgtcatcctatttgctgaggtcggtccctagtcgtaaggttccaggtggactaggtaggaactcgtgggaactaagtaaattccactctacacctatccaacagtctgacgaggtctagagttatttcgaactaactttaccttntacgtacaaacgtagtacgttacctacgttccctacgttaccgtttccggcccgttagggacctaagtagttgaattacgtaacaagttacgttgttacgntnaacctatacttcttcgttcttc

SEQ ID NO: 334803 - DNA, 544 bp, Homo sapiens
  misc_feature: GZ8MTXP01BZDWU.52.1.A01.1.454.CMB.2.raw
  modified_base (193)..(193): a, c, t, g, unknown or other
  misc_feature (193)..(193): n is a, c, g, or t
  modified_base (379)..(379): a, c, t, g, unknown or other
  misc_feature (379)..(379): n is a, c, g, or t
  modified_base (537)..(537): a, c, t, g, unknown or other
  misc_feature (537)..(537): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctcctgtccgcatctgtagganacagagtcatcatcacttgccgggcaagtcagagcattagaacgtattaaatggtatcaacagaaaccagggaacgcccctgaactcctgatctatggttacatccactttgctgagtcggggtccagtcaaggttcagtgacagtgatcgtgggacagtatcactctcaccatcaccagtctgcnggctgagtatttgacttaacttcttctgtacaacgagtacgttactacgttcccctcgtacctttccgggccctggggaccctaagttcggtagggtaattaacgttaccgttaaaaccggtaaccttgggtaaccggtcgtacggacctaaccgttntttcccg

SEQ ID NO: 334804 - DNA, 518 bp, Homo sapiens
  misc_feature: GZ8MTXP01D8MYX.52.1.A01.1.454.CMB.2.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (342)..(342): a, c, t, g, unknown or other
  misc_feature (342)..(342): n is a, c, g, or t
  modified_base (382)..(382): a, c, t, g, unknown or other
  misc_feature (382)..(382): n is a, c, g, or t
  modified_base (417)..(417): a, c, t, g, unknown or other
  misc_feature (417)..(417): n is a, c, g, or t
tcagcgcagtacgacacgaccggtgctcgatttagacgtctcatcaggggatgctttctgagagtcatggacctcctgtgcaagaacatgaagcacctgtggttttcctcctgctggtggcagctcccagatgggtcctgtcccacgtgcagctgcaggagtcgggcccaggactggtgaagccttcggagatcatgtccctnacctgctctgtctctggtnactcatcagcagtgtatactggctggtcggcngccccagggaagggtttgagtggattgggagtatcgatcacagtgggagcactactgaacccgtcctccacgactcgagtcgcccatncaacagacacgcaagaccagtcactgaggctgaactctgngaccgccgcagactacgggggcctatattattggngcgacggtactggtagggtgtatagtaaggtcgacgtacgttagttacgtattcgttcttcgtaacgtacgtcgggccggacggaccgtcgttcgtaaccg

SEQ ID NO: 334805 - DNA, 512 bp, Homo sapiens
  misc_feature: GZ8MTXP01D93IJ.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (454)..(454): a, c, t, g, unknown or other
  misc_feature (454)..(454): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttggagatcatgtccctnacctgctctgtctctggtnactccatcagcagttgttatactgggctggtccgcagccccagggaagggttgagtggattgggagtatcgatcacagtggagcactacctgaacccgtcctcacgacctcgagtcgcataatcaacagacacgtacaagaaccagttcactgagctgaactctgtcgaccgccgcacgacgacgccgtatattacttgtgcgcggacttcgaggggtgatatagtggctagnttcgttatctcttgcttacgtggggccaacgggtacctggttcctaaccgttctcccg

SEQ ID NO: 334806 - DNA, 533 bp, Homo sapiens
  misc_feature: GZ8MTXP01DHS5A.52.1.A01.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgaccccagtctcccatccctccctgtcccgcatctgtagganacagatcatcatcacttgccgggnaagtcagagctattaagaacgttatttaaatggtaaccaacaagaaaccgagggaaacncccctagaactctgatctatgtcatctattgctgnggtggtccatcaggttcagtgnagtgaatgngganagtaacttcactctacacctatacacctgtctgcgaggtctaggagttntttcgacttaactttcttgtagtacaaataggtacttactcgtttccctactaccgtttccgaccgtggacctaagtagttagacttacgaactaacggacgttgacggctacgctacgtattcgtgttccttaac

SEQ ID NO: 334807 - DNA, 543 bp, Homo sapiens
  misc_feature: GZ8MTXP01AXEO5.52.1.A01.1.454.CMB.2.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (475)..(475): a, c, t, g, unknown or other
  misc_feature (475)..(475): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatgtccctnacctgctctgtctctggtnactcatcagcagtgtattactggctggtcgcagccccgagggagggttgagtggattgggagtatcgatcacgagtgggagcacctacctgaaccccgtcctcacgacctcgagtcgccataatacaacagacacgtaccaaagaacctagttactacctgacggctacgaactctacgtcgacccgccgacagacgacggccgtatattagttgtacgcgcggcttcgaggggtgtatagtagtggctaggttnttcgttatcttccttagcttacggtcggggccgaagggtaaccctgggttacctaaccggttctcccg

SEQ ID NO: 334808 - DNA, 580 bp, Homo sapiens
  misc_feature: GZ8MTXP01BCS34.52.1.A01.1.454.CMB.2.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccggganaagtcagagctatagaacgtattaaatggtaatcaacaagaaaccgaggaaacncccctagaacctcagatctatggttcatccactttgctgagtggggtcccatcaaggttcagtgacagtgatgtagggacagtaattcactctacactatccacctagtcgtgacgaggctgaaggttattttacgacttaaactttctcttacgtacaaaccgtagtagtttacctacggtttacccctacgttaccgtttcccgggaaccctttcggggaaccctagttacggtaggaacttacgttaacccgttaaaaggtaacgttccgtaagggtccttcggacctaaccccgttgttccg

SEQ ID NO: 334809 - DNA, 755 bp, Homo sapiens
  misc_feature: GZ8MTXP01ESEW6.52.1.A01.1.454.CMB.2.raw
  modified_base (219)..(219): a, c, t, g, unknown or other
  misc_feature (219)..(219): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (725)..(725): a, c, t, g, unknown or other
  misc_feature (725)..(725): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccggganaagtcagagactaagttaagtaacgttaatttaaagtacggtaaaccaanaaacgaaaaccgagggaaaccncccctagaacctccgtagtactcgttagtcggttactacttccttagtttcgccgttaggtacgggttcgggggttacccttaagtaccgtaagggtttacccgagggttacggacgtaggttggtaaaacttccgggtaaggggaaacctaaagggttaaacctttccctaaccgtttacccaccctaaaccctacttacccaaacccgtacgttccgtaggacccgtaaggggttccttaagggtaaggtttactttacggaacctttaaaccgttttctttacggggtacgttaacctaaacgtacggttaaacctttaaccgtcccttttaccccgttaccgttacccggtttcccgggaccccggttacgggaaccttaaggttaggttacgtacttaaacgtaacgaaaacgttcgttggttaccggnttacgctaacctgttcttaacgttcgttcc

SEQ ID NO: 334810 - DNA, 728 bp, Homo sapiens
  misc_feature: GZ8MTXP01DUUD6.52.1.A01.1.454.CMB.2.raw
  modified_base (222)..(222): a, c, t, g, unknown or other
  misc_feature (222)..(222): n is a, c, g, or t
  modified_base (379)..(379): a, c, t, g, unknown or other
  misc_feature (379)..(379): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggccaggactggtgaagccttcggagatcatcgtccctcacctgcttctgtctctggtnactccatcagctagttgttattacgtgggccgtgggtccggcacgccccgagggtaagggtttgaggtggagttgggagtatcgatcaacgaggtgggagccacctaccgtcgtaaccccgtcctcaccgacctcgagtccgcataactacaacganaaccaccgtaccaaacgaacctacgttacctacccgtaggagtacgtagtaaccttcgtaggtccgaccggccgacgaacgaaccgacgggacccgttaattaacgtttaagtttcggtcggtaccgggtcgggttacccgtttacggggtaagggggttaggtaaagttaggttaagggttacgggtaacgtttaaacggttacggttttaccggttaaacgtttccgttacccgttttacggttaaccggtttaacccgggtaaccggggggtaccccggtaaaacgggggttaaaccccccgttggggttacccccgtaacccgggtttccctttaaccccccggg

SEQ ID NO: 334811 - DNA, 576 bp, Homo sapiens
  misc_feature: GZ8MTXP01A7UM1.52.1.A01.1.454.CMB.2.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (446)..(446): a, c, t, g, unknown or other
  misc_feature (446)..(446): n is a, c, g, or t
  modified_base (560)..(560): a, c, t, g, unknown or other
  misc_feature (560)..(560): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagagtcatcatcacgttgccgggnaagtcagagcaattagtaacgtatttaaatggtaaccaanagaaaccagggaaacnccctagaactcctgatctatgtcatcctatttgctgaggtcgggtccatcgaagttccaggtgcaggtgaattcgtgggacagtacttcactctacaccatcactagtctagcgtaggctaggaggtatttgaccttaactttacttgtcgttacaaactagtaacgtttaccncgtttacccctacgtaccgttttcccggacccgttggggaccctaagtaggttacggtaaattacgtaacgaaaacgttacgttgttacgggtaacctcggaaccaacccgttnttccgttcgttcctcg

SEQ ID NO: 334812 - DNA, 536 bp, Homo sapiens
  misc_feature: GZ8MTXP01DLMIY.52.1.A01.1.454.CMB.2.raw
  modified_base (216)..(216): a, c, t, g, unknown or other
  misc_feature (216)..(216): n is a, c, g, or t
  modified_base (273)..(273): a, c, t, g, unknown or other
  misc_feature (273)..(273): n is a, c, g, or t
  modified_base (482)..(482): a, c, t, g, unknown or other
  misc_feature (482)..(482): n is a, c, g, or t
  modified_base (516)..(516): a, c, t, g, unknown or other
  misc_feature (516)..(516): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagctaattagaacgtatttaaatggtaaccaacagaaaccgagggaaacncccctagaactcctgatctatggttcatccactttgctgaggtgggtcccagtcaaggttccaggtgcagtgaatcgtgggacagtaattcactctacaccatcacctagtctgcaggctagtaggtatttcgactaacttacttgtagtacaacgtagtagttactacgttccctactaccgtttcgcccgttagggacctaatacgngtattagtaaccgaaacgaacgttgttacggctnccactattctcgttcttaac

SEQ ID NO: 334813 - DNA, 643 bp, Homo sapiens
  misc_feature: GZ8MTXP01D5MQQ.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctccagatgggtcctgtcccacgtgcagctgcaggagtcgggcccaggactggtgaagcccttggagatcatcgtccctcacctgctctgtctctggtnactccatcagcagtgttatacgtggcgtggtcgcacgccccgagggtaagggtttgagtggagttgggagtatcgatcacgaggtgggagccaacctaccgtacgaaccccgtcctcacgacctcgagtccgccataactacaacgagaaccaaccgtaccaaacgaacctacgttacctacctaggacggtactacggaaacttccgtagtacgaacccgccgacgaacgaccgaaccgggtccgttaattagtttaagttggttcgccggtccgggtaccgttacggagggggtgtaagttagtgggtcggtaacttacgttagttcggttaaccttccccgttgaccgttacggttcgggggtaacccgaacgggtaacccgttcgggtcccgttacccggttcccttcccgtaacccg

SEQ ID NO: 334814 - DNA, 519 bp, Homo sapiens
  misc_feature: GZ8MTXP01BVZGG.52.1.A01.1.454.CMB.2.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccattccctccctgtccgcatctgtaggagacagagtcatcatcacttgccggnaagtcagagcatagaacgtattaaatgtacaanagaacaggaancctgactcngatctatgtcatcactttgctgagtgggtccatcaaggttccagtggcagtgaatctgggacagaattcactctcacatcacagtctgcaggctgaggtatttgctaactttacttctagtacaaacagtacgttacacgtttccctactaccgtttccggcccgtgggaccctaagtacgttgggtaacttaagttacgaaacgttaacgttggttcggaactcgaaccacctattccgtttcgttctc

SEQ ID NO: 334815 - DNA, 542 bp, Homo sapiens
  misc_feature: GZ8MTXP01AMM8H.52.1.A01.1.454.CMB.2.raw
  modified_base (343)..(343): a, c, t, g, unknown or other
  misc_feature (343)..(343): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggacaagtcagagcattagaacgtattaaatgtatacaacaagaaaccagggaaacgcccctagaactcctgactctatgttcatcctactttgctgaggtcgggtccagtcaggttcagtggacngtgatcgtgggacagtaactcactctacaccatccacagtcctgcgaggctagtaggttattttcgacttaacttacttctacgttacaacgtagtacgttacctacttccctactaccgtttccggcccgttagggaccctagttaggtagtaacttcttaacgaaaccgtaagtggcgactcgaccaacttcgttcg

SEQ ID NO: 334816 - DNA, 612 bp, Homo sapiens
  misc_feature: GZ8MTXP01BGW53.52.1.A01.1.454.CMB.2.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (373)..(373): a, c, t, g, unknown or other
  misc_feature (373)..(373): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggnaagtcagagcatagaacgtattaatgtacaanagaacaggaacnccctagaactctgatctatgtcatcctatttgctgagtcgggtccatcgtaaggttccaggtggctaggtggaatcgtgggacagaattcactctacaccatcacctagtctgngaggctaggtaggttatttcgaccttaaactttaccgttcgtacgttaacctaaactacggttaacgttacccgtaccgtttccccgtacctttacccgtttcccgggtaccccgttacggggaaccctaagtttaacggttaggtaaacttacgtaaaccgtaaaaccggttaacgttcggttacgggtcttacggaaccctaaccttacgttacccgttcgtttcccgtttaacccg

SEQ ID NO: 334817 - DNA, 618 bp, Homo sapiens
  misc_feature: GZ8MTXP01DRI9S.52.1.A01.1.454.CMB.2.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctcctgtccgtatctgtagganacagagtcatcatcacttgccggnaagtcagagacattaagaacgttattaaattggtaaccaacagaaaccgagggaaacgcccctagaacctcctagatctagtgttacactcctatttcgcgttggtaggttcgggggtaccctagtacgtaaggttcaaggtcggacgtaggtggatcgtagggaacaagtaacttacacctctacaacctactacccaaccgagttacctgaccgaggtcgtaggtaacgttattttacgaaccttaactttacttacgtacggtaactaaacgtaagtacgttactaccgttccctcgtaccgtttccggccgtgggaacctagtaacgtggttaaactacgaacgtaaaccgtagttggttcgactcgtaccaacgtactcgttacttccttcgttaacccg

SEQ ID NO: 334818 - DNA, 668 bp, Homo sapiens
  misc_feature: GZ8MTXP01ADH7P.52.1.A01.1.454.CMB.2.raw
  modified_base (108)..(108): a, c, t, g, unknown or other
  misc_feature (108)..(108): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttccncctgctggtggcagctcccagatgggtcctgtcccagtgcagctgcaggagtcgggcccaggactggtgaagccttcggagatcatcgtccctnacctgctctgtctctggtnactcatcagcagttgttattacgtggcctgggtccgcacgccccgagggacgggtttgagtggagttgggagtatcgatcgacgaggtgggagccacctacctcgaaccccgtcctcacgacctcgagtcgaccataactcaacacggaaccacggtaccaaacggaacctacggttacctacccgttaggacgggtactaggtaaaccttcgtacggtccgaacccgcccgacgaacggaccgaccgggtacccgttaattatttacgttggtacggtccggtaccggggtaccttgggaagggggttggtaagttaaggtagggttcggtaacgttaaccgggttatttcggttaacttccgtttaccgttgttaccgttaccgggttcgggggtacccgaacgggggtaaccccgtgggttacccgtaacccggttcttccccg

SEQ ID NO: 334819 - DNA, 566 bp, Homo sapiens
  misc_feature: GZ8MTXP01DHJ42.52.1.A01.1.454.CMB.2.raw
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctccagatgggtcctgtcccagtgcagctgcaggagtcgggcccaggactggtgaagccttggagatcatcgtccctnacctgctctgtctcgtggtnactcatcagcagttgttatacgtgggccgtgggtccgcacgcccccgagggaagggttgagtggagttggagtatgatcacaggtgggagcacctacctcgaaccccgtcctcacgacctcgagtcgaccataacacaacacgacaccgtaccaaacgaaccagttacctacctgaggctagaacttcgtgtacgaccgccgcaacgacacggaccgtaattattaagttggtgccggcgggtacttcggagggggtgtaatagtagtgggtctacgttattcgttatcttcttagcttacgtcgggccgtaacgggaacccgtggttacctccgttcgtaacccg

SEQ ID NO: 334820 - DNA, 748 bp, Homo sapiens
  misc_feature: GZ8MTXP01CCD5K.52.1.A01.1.454.CMB.2.raw
  modified_base (107)..(107): a, c, t, g, unknown or other
  misc_feature (107)..(107): n is a, c, g, or t
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
tcagcgcagtacgacacgaccggtgctcgatttagacgtctcatcagggggctttctgagagtcatggacctcctgtgcaagaacatgaagcacctgtggttttccncctgctggtgcagctccagatgggtcctgtcccagtgcagctgcaggagtcgggcccaggactgggtgaagcccttggagatcgatcgtcccctnaccttgcttctgtctcgtggtnacctcatcagctaggttgttattacgtgggccgtcgggtccgcgacgcccccgaggggtaagggttgaggtggagttagggagtagtcgatcgaacgaggtgggacgaccgtacccgtaaccgtaccggaaacccccgttcccgttaccgaccggtaacccccgttcggacgttcccggacccctaagtaaacttacccaacgaacgaaccaaacccgggttacccaaaacgtaaacccgtacgttacccgtaacccgttgaacgggtactacggtaaccttcgtacgttacgaacccgccgacgacgttaccgacgggtaccgttaattagtttaagttcgtcgggtacggccgggttaccgttaggtaacgggggttagtaagttaagtagggtcggtaaccgttaacggttacggttttacgttaactttcccgttcgtttacgttaccgttccgggttaacggggacccggtaacggtaaacccggttcggttacccgtaacccggttccgttaaccccg

SEQ ID NO: 334821 - DNA, 577 bp, Homo sapiens
  misc_feature: GZ8MTXP01A4Y1K.52.1.A01.1.454.CMB.2.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (558)..(558): a, c, t, g, unknown or other
  misc_feature (558)..(558): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgcggcaagtcagagcattagaacgttattaaatggtaacaanagaaaccgaggaaacnccctagacctctagatctatgtcactctactttgctgacggtcgggtcccagtcgaaggttccaggtgcagtgaatcgtgggacagtactcactcacacctatccacngtctgnacgntgagtatttgacttaacttacttcgtacgactaactaggtaactttaccacgtttccccttacgtaaccgttttcccgggacccgttacgggaaccctaagtacgggttaacggtattaaccgtaaacgaaaacggttacgttgggttaccggcttacggcctaacccgttnttaccgttaacgtttcctc

SEQ ID NO: 334822 - DNA, 551 bp, Homo sapiens
  misc_feature: GZ8MTXP01CS7C2.52.1.A01.1.454.CMB.2.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (489)..(489): a, c, t, g, unknown or other
  misc_feature (489)..(489): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttgganatcatcgtccctcacctgctctgtctctggtnactccatcagcagttgttattactgggcctgggtcgcagcccccgagggaagggttgaggtggagttgggagtatcgatcacgagtgggagcacctacctgaacccgtccctcacgacctcgagtcgaccataactacaacagacacgtaccaaacgaacctacgttactacccgttgaggtctagaaacctctgtacgaccgccgcacgacacggccgtatattagttgtgcgtcggacttcggaggggtgatagtagtggctacgnttcgttatcgtcttgacttacgtcggggaccgtcgggaaccctggctaaccgttcgtaaccc

SEQ ID NO: 334823 - DNA, 686 bp, Homo sapiens
  misc_feature: GZ8MTXP01CMAH4.52.1.A01.1.454.CMB.2.raw
  modified_base (284)..(284): a, c, t, g, unknown or other
  misc_feature (284)..(284): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggacaagtcagagtcattagaacgttaatttaaagttaggtaaccaaacgtaacgaaacgaacgggaaaccnccccgtagaacctcgtagtactctatcggttcactcctactttgcgtggacggtcggggtaccctagtacgtaaggttccaggtgcgtaggtggaattcgtcgggactaaggtaacttcgaccttactacaaccctataccaaccgtgtacgtgccgaggtccgtaggtagttagtttacgacttaaacctttacgttcgtacgttaaccgaaacgtacggtaaccgtttaaccgtacccggtttaccccttaccgttaaccccgtttccggggtaccccgtaccgggtaacgtaaccggttaagttacgggtaaacttaacgtaaaccgtaaaccggttacgttacggttcgggtaacctacggtaacccctagtacctttcgtcgtttccgtttaacccg

SEQ ID NO: 334824 - DNA, 569 bp, Homo sapiens
  misc_feature: GZ8MTXP01AFENK.52.1.A01.1.454.CMB.2.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagcgcagtacgacacgaccggtgctcgatttagacgtctcatcagggggagtcagtctcagtcaggacacagcatggacatgagggtccccgctcagctccgtggggctcctgctactctggctccgaggtgccagatgtgtcatccagatcgacccagtctccatccctccctgtccgcatctgtaggagacagagtcatcatcacgttcgccgggcaagtcagagctaattaagaacgttaatttaaagtcggtaaacccaaaccgaaaccgaagggaaacgcccctagaacctcctgatctatgtcatctatttgctgaggtcgggtccagtcgtaagtcagtgngagtgatgaggaacagatcactcacacatcacngtctgcaggtctagtaggttatttcgacttacttacttcgtaggtacaacgtagtacgttacctacgtttccctacttaccgttccggtacccgtaggaaccctgttaagtaggttaactacgttaaacgtaaaacgtacgttcggttcgttcgtcgacctaaccgtatcttctcttccgtaaccg

SEQ ID NO: 334825 - DNA, 510 bp, Homo sapiens
  misc_feature: GZ8MTXP01EJEHX.52.1.A01.1.454.CMB.2.raw
  modified_base (220)..(220): a, c, t, g, unknown or other
  misc_feature (220)..(220): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatgtccctcacctgctctgtctctggtnactcatcagcagtgtatactggctggtcgcagccccagggaagggtttgagtggattgggagtatcgatcacagtgggagcacctacctgaacccgtcctcacgacctcgagtcgccataactcaacagacacgtaccaaagaaccagttactacctgaggctgaactctgtgaccgcgcagacacgccgtatacttatgtgcgcggactcgaggggtgatagtagtgctagattcgttatctcttgcttacgtgggcctaacgggaaccctggactaaccgttcgtccc

SEQ ID NO: 334826 - DNA, 580 bp, Homo sapiens
  misc_feature: GZ8MTXP01CAK82.52.1.A01.1.454.CMB.2.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtagganacagngtcatcatcacttgccggnaagtcaganctatagaacgtattaaatggtacaacagaaacgaggaacnccctagaactctgatctatgtcatctattgctgngtcggtccatcgagtccaggtgcgagtggaatcgtgggactagtattcactctacactatccgacctagtcgtagcgaaggtcgtagtaggttatttacgacttaactttacgttcgtacgtactaaacgtacgtaacgttaccacgtttccctactaccgtttccggcccgtaggggtaccctaagttaaggttggtaaacttacgtaaaccgtaacgttaaacggttcggttacgggtctacggtcctaaccctatttccgtcggttcttttaaccccg

SEQ ID NO: 334827 - DNA, 591 bp, Homo sapiens
  misc_feature: GZ8MTXP01A6K0V.52.1.A01.1.454.CMB.2.raw
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgtattaaatggtacaacagaacagggaaacnccctgaactcctgatctatggttacatcctactttgcctgtacggtcgggggtccccagtaccgtaaaggttcccaggttgggctagtggaattcgngggtacagtaaattcaactctcaacccatacacccagttccgngacgagtcgtagtagttattacgtacttacttacttacgtactaactaacgtagttacttaccgtccgttaccctacgttaccgttccggtaccgtacggacctaagtaggttagtaacttaacgtaaacgtaaacgttacgttggttcggtaactcgtaacctacctacgttcttcgttccttc

SEQ ID NO: 334828 - DNA, 529 bp, Homo sapiens
  misc_feature: GZ8MTXP01ADNBP.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (409)..(409): a, c, t, g, unknown or other
  misc_feature (409)..(409): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
  modified_base (493)..(493): a, c, t, g, unknown or other
  misc_feature (493)..(493): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttcggagatcatgtcccctnacctgctctgtctctggtnactcatcagcagtgttatactggctggtcgcacgccccgaggagggtttgagtggnttgggatatcgatctacgagtgggagcaacctacctgaaccccgtcctcacgacctcgagtcgcataacncaacagacacgtaccaaagaccagttcctacctgaagtctagaacttcgtgtcgaccgccgnacgacacggtccgtattaatgttgtcgcgcggcttggaggggtgatatggngtcgtacgttnttcgttattcgtcttgcttagnggggccaagggtaccctggttccaaccgttctcccg

SEQ ID NO: 334829 - DNA, 590 bp, Homo sapiens
  misc_feature: GZ8MTXP01AL54Z.52.1.A01.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactcatganctagttgttatacgtgggcgtgggtccgcacgccccgagggtagggtttgagtggagttgggagtatcgatcgacgaggtgggagccacccgtaccgtccgtaaccccgtcccctacgacgacccgtcgacgtccgacccattaacacaacagaaccacgtaccaacgaacctagttacctaccgtgaggctaggaactcgtaggtcgaccgcgacacgaccgacgtcgtagttattagttggtacgcggtcggtcgttcggagggggtgtagtagtagtggctagttacgttcgttattcttccttgccttacggcgggtccgaacggtaccctcgggttcctaaccgttcgtccccg

SEQ ID NO: 334830 - DNA, 602 bp, Homo sapiens
  misc_feature: GZ8MTXP01B826O.52.1.A01.1.454.CMB.2.raw
  modified_base (224)..(224): a, c, t, g, unknown or other
  misc_feature (224)..(224): n is a, c, g, or t
  modified_base (323)..(323): a, c, t, g, unknown or other
  misc_feature (323)..(323): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtcccctcacctgctctgtctcgtggtnactcatcagctagttgttattacgtggccgtgggtccggcacgccccgagggtaagggtttgagtggtagttgggagtagtcgatcgacgaggtggganccacctacctcgaaccctcctacacgtacctcggagtcgcataactacaacagaaccacgtacaaagaaccagttactaccgtgacggctagaactcgtagtcggaccgccgacgaacgaccacgggtccttaagttacgtttagttgtcggccgtcggggtacttcgggaagggggtgtagtagtaggtcggcgtagttagtttcgttatccttcgttgacttcggtcggggaccgtaacggggtaccctcgggttacctaacccggttcgtaacccg

SEQ ID NO: 334831 - DNA, 549 bp, Homo sapiens
  misc_feature: GZ8MTXP01ADQMG.52.1.A01.1.454.CMB.2.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
tcagcgcagtacgacacgaccggtgctcgatttagacgtctcatcagggggagtcagtctcagtcaggacacagcatggacatgagggtccccactcagctcctggggctcctgctactctggctccgaggtgccagatgtgtcatccagatcgacccagtcctccatccctccctgtccgcatctgtagganacagagtcatcatcacgttcggccgggacaagtcagagctaattaagaacgttatttaaatggtaaccaacagaaaccagggaaacnccctagaacctctgatctatgttcatcctatttgctggaggtcgggtcccagtcgaaggttccagtgacgagtgaacttcgnggacagtaatcactcncacacncactgctgcgngngtagtagtattactactacttactcgtactacgtacgtacgtacgttactccttccttcctccgtccgtccgtacgtacgtaagtacgttagtacttacgtaacgtaacgttacgttcgttcgtcgtcgtaactactacttcttcgttcgtc

SEQ ID NO: 334832 - DNA, 560 bp, Homo sapiens
  misc_feature: GZ8MTXP01AVQ8V.52.1.A01.1.454.CMB.2.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttcgganatcatcgtccctnacctgctctgtctctggtnactcatcagcagtgtatacnggctggtcgcacgccccgagggagggttgagtggattgggagtatcgatcacgagtgggacncacctacctcgaacccgtcctcgacgacctcgagtcgcctataactacaacagaacacgtacaagaccagttactacctgacggctagaactctacgtacgaccgccgacacgaccacgggtcctaattacgtttagtggtgacggtcggtacttcggaggggtgtatagtagtggctagttatcgttatcgttccgttgcgttacggtcggggacctaacgggtaaccccgtggttaccctaaccgttccgtcccg

SEQ ID NO: 334833 - DNA, 648 bp, Homo sapiens
  misc_feature: GZ8MTXP01CU8S9.52.1.A01.1.454.CMB.2.raw
  modified_base (219)..(219): a, c, t, g, unknown or other
  misc_feature (219)..(219): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtcccgcattctgtaggagacagagtcatcatcacttggccgggnaagtcagagctaattaagaacgttaatttaaattcggtaaccaaacaagaaaccgaagggaaacgcccctagaacctctgatctatggtactatcctactttgcgtaggacggtcgggtaccctagtacgtaaggttcaggtggcgtagtggaatcgtgggactaagtacttcacctctacaccactccacctagtctcggacagggtctaggtagttactttcgaccttaaactttccgttctagttaccgaaactacggttaacgttaacccgtacgtttcccctttaccgttaccgtttccccggggacccgttacggggaacccttaaggtacgttagggtaaacttacgttaaaccgaaacgttacggttcggttacggtcttcgaaccttaaccctagttcgtttcgtttcccgtttaacccg

SEQ ID NO: 334834 - DNA, 563 bp, Homo sapiens
  misc_feature: GZ8MTXP01EQHB1.52.1.A01.1.454.CMB.2.raw
  modified_base (548)..(548): a, c, t, g, unknown or other
  misc_feature (548)..(548): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggacaagtcagagcttttaatagtaacgttaatttaaagttacggtaaccaaacaagaaaaccgagggaaaacgcccctagaacctcctagatctatggttcatcctactttgcttggaggtcgggtcccagtcgtaaggttcaggtgcgagtggaatcgtggactagtaattcactctcaaccatacaccagtctagcaggtctgtagtatttgactaaactttcttctgtacaatacgtagttactacgttccctactaccgtttccggcccgttcgggacctaagtaggttaggaattagtacgaaaacgttcgttggcggtcctgcctactnttccgttcgttcttc

SEQ ID NO: 334835 - DNA, 550 bp, Homo sapiens
  misc_feature: GZ8MTXP01DWC26.52.1.A01.1.454.CMB.2.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccggnaagtcagagcattagaacgtatttaaataggtaacaanaagaaaccgagggaaacgccctagaacctctgatctatgtcatctactttgctgagtgggtccagtcgaagttcaggtgcagtgaatcgtgganagaatcactcacacatcacagtctgcagctgagtatttgactaacttcttctacgtacaaacgtagtagttacctacgtttccctacgtaccgtttccggacccttaggggaccctaagttaggttaggtaacttacgtaaacgtaaacggttacgttgggttacggcttagcctaacctgttcttcggttctttaacccg

SEQ ID NO: 334836 - DNA, 670 bp, Homo sapiens
  misc_feature: GZ8MTXP01EX2SX.52.1.A01.1.454.CMB.2.raw
  modified_base (222)..(222): a, c, t, g, unknown or other
  misc_feature (222)..(222): n is a, c, g, or t
  modified_base (318)..(318): a, c, t, g, unknown or other
  misc_feature (318)..(318): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtcccctcacctgctctgtctctggtnactcatcagcagttgttattacgtgggcctgggtccggcacgcccccgagggtaagggtttgagtggagttgggagtatcgatcacgagtggggancctacctacctgaaccccgtccctcacgacctcgagtcgccataactcaacagaacacgtaccaaagtaaccagttacctacctgacggactaggaacctcgttagcggaacccgccgacgagaccgaccggtacccgttattagttttaagttgggtcgtcgggtaccgggtactttacggaagggggttgggtaattaaggtaacgggttgggtaactttaaccggttagttttaccggttaacgttcccttaccgtttacggaaccgtttacggggttccggggggacccgtaaccgggggtaaaccccttgggggttacccctaaccccgggtttccttaacccccgg

SEQ ID NO: 334837 - DNA, 575 bp, Homo sapiens
  misc_feature: GZ8MTXP01CVN3R.52.1.A01.1.454.CMB.2.raw
  modified_base (194)..(194): a, c, t, g, unknown or other
  misc_feature (194)..(194): n is a, c, g, or t
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatcgacccagtctccattccctccctgtccgcatctggtagganacagagtcatcatcacgttgccgggacaagtcagagactattagaacgttatttaaagtcgaacaanagaaaccgaggaaacncccctagaacctctagatntatgtcactcctatttgcgttagacgggttcggtacccagtacgtaaggtttccaggttggctaaggttcggaattcggtgggactaagtaacttcactctacacctacncaaccngtcngacgagtctagtagttnttacgacttaacttcttacgtacgtaactaacgtacgttacttaccgtccttccctacgtccgttccgccgtaggactaagtgagtaacttacgtaacgaacgttacgttgacgtcctacgctacctgttccttcgttcgtc

SEQ ID NO: 334838 - DNA, 535 bp, Homo sapiens
  misc_feature: GZ8MTXP01BR571.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgtattactggctggtccggcacgccccgagggaagggttgagtggattgggagtatcgatcacgagtgggagcacctacctcgaacccgtcctcacgacctcgacgtcgccataatcaacagacacgtaccaacgaaccagttacctacctgacggtctagaacctcgtcgtacgaccgccgcagacacggccgtatattattgtgcgtcggacttcgaggggtgatagtagtggaactagattcgttatctcttgcttacgtcggggccaagggtaaccctggacctccgttcttccccg

SEQ ID NO: 334839 - DNA, 608 bp, Homo sapiens
  misc_feature: GZ8MTXP01EOSCZ.52.1.A01.1.454.CMB.2.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
  modified_base (368)..(368): a, c, t, g, unknown or other
  misc_feature (368)..(368): n is a, c, g, or t
  modified_base (585)..(585): a, c, t, g, unknown or other
  misc_feature (585)..(585): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagatcatcatcactggccggnaagtcagagctattagaacgttatttaaagtggtaaccaaacaagaaaccgagggaaacnccctagaacctcctgatctatggttcactcctatttgctggacggtcgggtcccagtacgtaaggttccaggtggctaggtgaatcgtggganagtaattcactctacaccagtccactgtactgcgaggtctagaggttattcgacttaaacttcttacgtcgtactaaagtagttaacgttacctccgtttaccctaccgttaccgtttcccgggcccgttacggggacccttaaggttacgggttaggtaacttaaacgtaaccgtaaacgttacgttggttaacgggtcttacggaactaaccgtnttccgttcgtttaacctttcccg

SEQ ID NO: 334840 - DNA, 561 bp, Homo sapiens
  misc_feature: GZ8MTXP01CKZE1.52.1.A01.1.454.CMB.2.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctnacctgctctgtctctggtnactcatcagcagttgttattacgtgggcctgggtccggcacggcccccgaggggaaggggtttgaggtggagttgggagtatcgatcacgaggtgggagcaacctaccgtcgaaccccgtccctcacgaccctcgagtcgccataactcaacacgacaccgtacaagaaccagttacctacctgacggctgaactcgtgtcgaccgccgacacgacacggccgttatactttagttgtaggcgcgggtacttcgaggggtgtatagtaggtggctacgattcgattcgtcttgacgttacgtggggcctaacggggaccctggcctaaccgttctcccg

SEQ ID NO: 334841 - DNA, 672 bp, Homo sapiens
  misc_feature: GZ8MTXP01CRYB4.52.1.A01.1.454.CMB.2.raw
  modified_base (183)..(183): a, c, t, g, unknown or other
  misc_feature (183)..(183): n is a, c, g, or t
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgnatctggtaggagacagagtcatcatcacttggccggganaagtcagagactattaagaacgttaatttaaatggtaatacaacaagaaaccgagggaaaccncccctagaactcctagatctatcggttcactccctactttgacgttgtacggtcgggtcccctaagtacggtaaggttcgaaggttcggaacctaagggtcggattcggtaaggggaactaagtaacttccaacttcttaccaaccactcacccgtagtcctagaccgaaggtcgtaggtaggttacttttgaccgttaaacttccgtttctagtacctaagtacgttacgtttaaccgtccgttccccttacgttacccggtttccggccccgtttacgggacccttaagacgggttaagtaaccgttaaacgttaccggttaaaaaaccgttaacggttacgggtccggtacgtttccggacctaaccccgttaagttttccccg

SEQ ID NO: 334842 - DNA, 563 bp, Homo sapiens
  misc_feature: GZ8MTXP01EYKD4.52.1.A01.1.454.CMB.2.raw
  modified_base (217)..(217): a, c, t, g, unknown or other
  misc_feature (217)..(217): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
  modified_base (563)..(563): a, c, t, g, unknown or other
  misc_feature (563)..(563): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagcattagaacgtattaaatggtaccaacagaaaccagggaaacgccctgaactcctgatctatggttcatcctacttgctgaggtgggtccagtcgaaggttccaggtgcgagtgaatctggggacagtatcactctcacctatcacctagtcgtcgacgtaaggcttaggtacgggttaattttggaccttaaactttaactttcggacggtttaaccaaacgtacggttaacttaccgtactttcccctactacgtttccggcccgtcgggaacctaagtagttgggattatacgaaaacgcttggttacggctnaactacnttacgttgttcgtn

SEQ ID NO: 334843 - DNA, 523 bp, Homo sapiens
  misc_feature: GZ8MTXP01C9XVY.52.1.A01.1.454.CMB.2.raw
  modified_base (108)..(108): a, c, t, g, unknown or other
  misc_feature (108)..(108): n is a, c, g, or t
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (434)..(434): a, c, t, g, unknown or other
  misc_feature (434)..(434): n is a, c, g, or t
tcagcgcagtacgacacgaccggtgctcgatttagacgtctcatcagggggctttctgagagtcatggacctcctgtgcaagaacatgaagcacctgtggtttttccnctgctggtgcagctcccagatgggtcctgtcccagtgcagctgcaggagtcgggccaggactggtgaagccttggagatcatcgtccctnacctgctctgtctctggtnactcatcagcagtgtatactggctggtcgcagccccaggaagggttgagtggattgggagtatcgatcacagtgggagcacctacctgaacccgtccctcgacgacctcgacgtcgaccataactacaacacggaacacgtaccaaagaaccagttcaccttgagctgaacttcgtagtcgaccgccgcacgacacgggcctatacttagtgtgcgnggctgaggggtgtagtatagtgaactacggattcgttatcttcttgacttacgtgggccaagggacctggttcaaccgttcgtaacccg

SEQ ID NO: 334844 - DNA, 703 bp, Homo sapiens
  misc_feature: GZ8MTXP01A84CV.52.1.A01.1.454.CMB.2.raw
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctcgtggtgacctcatcagtctagttggttattacgtgggccgtcgggtccggcgaccggccccggaggggtaacgggtttggaggtggtagttgggagtagtcgatcgacgaggtgggacgaccacccgtaccgtacgaacccccgtccctacgaccgaccctcggacgtccgacctaataactacaacgacgaaccgtaacccgtaccaaacgtaaccgtaacgttaccctaacccgtggaacgtccgtaggaaccttcgtcggtacggaaccccgccgacgaacgaccgtacggtaccgttaagttacgttaagttcggtcggccggtacgggtacgttcggtagggggtgtaagttaggtacggttggtcttaacggttacgtttcggttaacttccgttacccgttacggttacccgtttacgggccgggggtaccccgtaacggggtaccccgttcggttacccgtcccggttcccttccccg

SEQ ID NO: 334845 - DNA, 674 bp, Homo sapiens
  misc_feature: GZ8MTXP01BBGB6.52.1.A01.1.454.CMB.2.raw
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggcgaagccttcggagatcacgtccctcacctgctctgtctcgtggtcactccatcagcagttgttatacgtggcgtgggtccggcacggccccgagggtagggtttgaggtggagttgggagtatcgatcgacgaggtgggacgcacctaccgtcgacccgtccctcgacgactccgacgtcgacatactaacaacaagacaccgtaccaacgaacctacgttactaccgtgacgtctagaactcgtcgtacggaacccgccgacgaacgaccgaccgggtacgttaacttacggttagttcgggtacgcgggtacgggtaccgttacgggagggggttaggtaacgttagtacgggttcggacgttaacggtacgttttacggttaacttcccggttaccgtttaacgttaccggttcgggttaccgggggtaacccggtaccggggtaaacccggttcgggtaccccttaaccgggttcccttcccgttaaccccgg

SEQ ID NO: 334846 - DNA, 549 bp, Homo sapiens
  misc_feature: GZ8MTXP01EH8GB.52.1.A01.1.454.CMB.2.raw
  modified_base (216)..(216): a, c, t, g, unknown or other
  misc_feature (216)..(216): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagatcatcatcacttgccgganaagtcagagcaattagacgtattaatagtacaacgaacaggaacncctagactcngatctatgtnatctattgctgagtcgggcctatcgagttcagtggcagtgatcgnggnagatcactctcacataccactagtctgacgaggtactagaggttatttcgactaacttacgttctacgtacaacgtagtaacgtttactacgttccctacgtaccgtttccggcccgtaggacctagtaacgtaggttactacgttaaccgaaacgtacgtttcggacgggttctcggtaaccctaacgtaacgttcttacggttcctttccgttaaccc

SEQ ID NO: 334847 - DNA, 639 bp, Homo sapiens
  misc_feature: GZ8MTXP01BVK3H.52.1.A01.1.454.CMB.2.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtagganacagatcatcatcacttggccggnaagtcagagactatagaacgtattaatgtacanagaacaggaancccngactctgatctatgtcatctattgctgagtcgggtccagtcgaagttccaggtgacgtagtggaactgtgggacagtaattcacttctacaacctactaccacctagtcgtcgacgtaacggtccgttaggtacgggttatttccggaactttaaaccttttacctttaccgttacgtaaccgtaaacgtaaggttaaccggtttaaacctcccggttttacccctaccgtttaaccgtttccccggtacccgttaacggggtaccctaaggttacggttaggtaacttaaacgtaaccgtaaaaccgttaagttcggttacgggtccttaccggaaccttaacccgttacgtttaccgttcgtttaaccttccg

SEQ ID NO: 334848 - DNA, 587 bp, Homo sapiens
  misc_feature: GZ8MTXP01BJW7J.52.1.A01.1.454.CMB.2.raw
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (502)..(502): a, c, t, g, unknown or other
  misc_feature (502)..(502): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggccaggactggtgaagccttcggagatcatcgtccctnacctgctctgtctcgtggtnactcagtgagctagttgttattacgtgggcctgggtccggcacgccccgagggaagggttgagtggagttggagtatcgatcacgaggtgggacgcacctacctcgaacccgtccctcacgactcggagtccgaccataatacaacagacacgtaccaacgaaccagttcaccgtgaggctgaactcgtcgtcgacccgccgcacgacgacggtccgtaattatttagttgtcgcggcgggtcttacggagggggtgtagtagtggtcggtctacggttnttcgttagtccttccgttagccgttaacggtcggggacccgtaacggggtaccccgtcgggttccctaacccggttcgttccccg

SEQ ID NO: 334849 - DNA, 555 bp, Homo sapiens
  misc_feature: GZ8MTXP01B0CL2.52.1.A01.1.454.CMB.2.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacgttgccgggnaagtcagagctatagaacgttattaaatgtaaccaanagaaaccgaggaacnccctagacctctgatctagtgtcatcctatttgntggacggtcggtccagtcgtaaggttccgaggtggcgtaggtcgaactcgtgggactagtacttcactctacaccatccactagtctgcaggtctaggtagttatttcgacttaacttcttcgtagtacaatacgtacttacctacgttcccgtacttccgttccggcccgtagggacctaagtaggttacgtaattagtaaaccgaacgttacgttggacggtctcncctactnttcgttcgttcttaacc

SEQ ID NO: 334850 - DNA, 742 bp, Homo sapiens
  misc_feature: GZ8MTXP01BTGDK.52.1.A01.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatcgaccagtctccatccctccctgtccgcattcgtggtaggagacaggactcatcatctacgttggccggganaagtcaagngactaattaagtaaacgttaatttaaacgtacggtaaaccaaacgaaacggaaaacccgtaacggggaaaacctccccgtaagtaaccctaccgtagaacttacgtaagttcggttactacgttacctacgttttcgccgtttaggtacgggttccggggtaccctagttacggtaacggtttaccgagggttacggacgtaggtcggtaacttcgggtggggaactaggtaacttccacgtctaccgacctataccaacgtagtcgtagacgtaagggtcgttagtacggtttattccgtaaaccttaaactttccgttacgtaggttaaccaaacggttaacgttaacgttaccccttacggtttaccccttagtttaccccgttaccgggtcccgtaacgggtactaaggttacgagggttaaacttaacgtaaaccgtaaaacgttcggttcggttaccggcttccggaacccttactagtttcctaaccgttcgtttaacccg

SEQ ID NO: 334851 - DNA, 625 bp, Homo sapiens
  misc_feature: GZ8MTXP01EYMMH.52.1.A01.1.454.CMB.2.raw
  modified_base (216)..(216): a, c, t, g, unknown or other
  misc_feature (216)..(216): n is a, c, g, or t
  modified_base (585)..(585): a, c, t, g, unknown or other
  misc_feature (585)..(585): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcactggccggnaagtcagagctaattagaacgttaattaatacggtaacccaaaccgaaacgaagggaaacacccgtagaactcctgattactagtgtactactcctatttcgcgttggtaggtcggggtacctagtacgtaaggttcgaggtaggcgtaggtggtactacggtagggaactagtaaacttccacctacctaccactactaccaccgtagtcgtgacgtaggtcgtagtagtacgttttacgacttaacttacttctacggtactaaacgtagtacgttaactaccgttccctagttacccgttccggtacccgtaggtacctagtaaggtagttataacgttaacgtaaacggtaacttgggttaccgngtaaccgactaacctagtcttcgttcttaaccgttaaccg

SEQ ID NO: 334852 - DNA, 667 bp, Homo sapiens
  misc_feature: GZ8MTXP01B4J2T.52.1.A01.1.454.CMB.2.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
  modified_base (650)..(650): a, c, t, g, unknown or other
  misc_feature (650)..(650): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatcgacccagtcctccatccctccctgtccgcatcgtgtaggagacagagtcatcatcacgttcggccggganaagtcagagctaattaagtaaacgttaatttaaagttacggtaaccaaacaacgaaaaccgaagggaaaccncccctagaacctcctgtactctagttgttcacttcctacgtttgacgtggtacggttccggggtaccctaagtacggtaaggtttccgaagggtggacgtaggtggtaacgtcgggtaacgggaaactaacgttaaacttccacccttactacccaacccgtactcccaaaccgtgtctcggcggtaaggtcgtaaggttaacggtttactttacgaacctttaaactttccttacggtgttaaccaacgtacgttaacgttacccgtaccgttcccttaccgttacccgtttccggacccgtaggtacctaaggttgttacgtattactaaacgaacttacgttgttacgctncctactgttctcttctc

SEQ ID NO: 334853 - DNA, 557 bp, Homo sapiens
  misc_feature: GZ8MTXP01CBRET.52.1.A01.1.454.CMB.2.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagctatagacgttattaatgtacaanagaaccgaggaacnccctagactctagatctatgtcatctatttgctgnggtcggtccatcgtaggtccaggtgctagtggaatcgtggactagtacttcactctacacctatccaactgtcgtgacgaggtcgtgtacggttctttgacttaacgtttcttcggtgtaacaactagtactttaccgccgtttcccttacgtaccgtttccgggacccgtacgggcctaagttggttacggtacttacgtaaaccgaacgttacgttggttacggtctacgcctacctattccgttcgttccttaacc

SEQ ID NO: 334854 - DNA, 521 bp, Homo sapiens
  misc_feature: GZ8MTXP01ASI3L.52.1.A01.1.454.CMB.2.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (294)..(294): a, c, t, g, unknown or other
  misc_feature (294)..(294): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggccaggactggtgaagccttggagatcatgtccctnacctgctctgtctctggtnactcatcagcagtgtatactgggctggtcgcagcccccagggaagggtttgagtggattgggagtatcgatcganacgtgggagcacctacctgaaccccgtcctcacgactcgagtcgccataatcaacagacacgtccaagacagtctacctgagctgaactctgtgaccgcgcagacacggccgtagtattatgtgcgcggactttcgagggggtgatactagtggctacggnttcgttagtctcccttgttaccncgtcggggccaacggggaacctgggttccaaccggttctcccc

SEQ ID NO: 334855 - DNA, 598 bp, Homo sapiens
  misc_feature: GZ8MTXP01EPTUK.52.1.A01.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (418)..(418): a, c, t, g, unknown or other
  misc_feature (418)..(418): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtagganacagatcatcatcacttggccgggnaagtcagagctatagaacgttaattaatgtaacaanagaaacgaggaaacncccagactctgatctatgtcactctatttgctggtacggtcgggtacccagtaccgtaaggttccaggttaggcgtaaggtcgggtaaatcgtggggactaggtaaacttctactactacaacctataccacctagtctcgacgagggtntaggtagttattacgtacttaacttacttcgtacgtaacaacgtacgtacttaccttaccgttccctacgttaccgttccggtaccgtacggtaactaagtcggttacgtaattaaacgtaacgtaaacgttacgttggttacggtctacgtaacctacgtacttcgttaacgttccttc

SEQ ID NO: 334856 - DNA, 491 bp, Homo sapiens
  misc_feature: GZ8MTXP02I7Z22.52.1.A01.1.454.CMB.2.raw
  modified_base (420)..(420): a, c, t, g, unknown or other
  misc_feature (420)..(420): n is a, c, g, or t
tcagcgcagtacgacacgaccggtgctcgatttagacgtctcatcaggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaatggtaccaacagaaaccaggaaagcccctgaactcctgatctatggttcatccactttgctgagtggggtcccatcaaggttccagtgcagtggatctggggacagaattcactctcaccatcaccagtctgcaggctgaggtatttgctaaacttacttctgtacaactagagttaacngtttccctctactttcggcctgggacctatagtgatatacaaacgaactgtggctcgcacactctctcttc

SEQ ID NO: 334857 - DNA, 488 bp, Homo sapiens
  misc_feature: GZ8MTXP02IMU8J.52.1.A01.1.454.CMB.2.raw
  modified_base (214)..(214): a, c, t, g, unknown or other
  misc_feature (214)..(214): n is a, c, g, or t
  modified_base (427)..(427): a, c, t, g, unknown or other
  misc_feature (427)..(427): n is a, c, g, or t
tcagcgcagtacgacacgaccggtgctcgatttagacgtctcatcaggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtattaaatggtacaacagaaaccaggaaagcccctgaactcctgatctatggttcatccactttgctgagtgggtccatcaaggttccagtgcagtggatctggggacagaattcactctcaccatcaccagtctgcaggctgaggtatttgctaaacttacttctgttacaactagaagttacacgttccctntactttcggccctgggacctagtagtgactatacaaacgactgtgctgcacatcttctctc

SEQ ID NO: 334858 - DNA, 498 bp, Homo sapiens
  misc_feature: GZ8MTXP02IOLW6.52.1.A01.1.454.CMB.2.raw
  modified_base (270)..(270): a, c, t, g, unknown or other
  misc_feature (270)..(270): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcatagaacgtattaatggtatcaacagaaaccagggaaacncccctgaactcctgatctatggttcatcctactttgctgagtggggtcccatcaagttcagtggcagtggatcgtgggacagtaattcactctcaccatcacagtctgcaggctgagtattttgactaactttacttctgtacaacagtagttacacgttccctctacgtttccgccgtgggacctagtagtcgatactacaaaacgtaactgcggtctgacactatc

SEQ ID NO: 334859 - DNA, 503 bp, Homo sapiens
  misc_feature: GZ8MTXP02JT85T.52.1.A01.1.454.CMB.2.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
tcagcgcagtacgacacgaccggtgctcgatttagacgtctcatcaggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactccatcagcagtgttatactgggcctggtccgcagcccccaggagggtttgagtggattgggagtatcgatcacagtgggagcacctacctgaaccccgtcctcacgacctcgagtcgccatatcacagacacgtccaagaaccagttcactgagctgaactctgtgaccgcgcacgacacggccgtatacttattgtgcgcggacttcgaggggtgatagtagngctacgntcgtatctcttgactacgngggccagggacctggtccaccgtctacccg

SEQ ID NO: 334860 - DNA, 510 bp, Homo sapiens
  misc_feature: GZ8MTXP02G38OD.52.1.A01.1.454.CMB.2.raw
  modified_base (264)..(264): a, c, t, g, unknown or other
  misc_feature (264)..(264): n is a, c, g, or t
tcagcgcagtacgacacgaccggtgctcgatttagacgtctcatcaggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaatggtaccaacagaaaccaggaaancccctgaactcctgatctatggttcatccactttgctgagtgggtcccatcaggttccagtgcagtggatctgggacagaattcactctcaccatcaccagtctgcaggctgaggtattttgactaaactttacttctgttcaactagtaacgttacacgttccctactaccgtttcggtacccgtgggaccctaagtaggtaggatacgtactaaacgactgtcggctgacacatcctgtcttac

SEQ ID NO: 334861 - DNA, 558 bp, Homo sapiens
  misc_feature: GZ8MTXP02IXM9G.52.1.A01.1.454.CMB.2.raw
  modified_base (215)..(215): a, c, t, g, unknown or other
  misc_feature (215)..(215): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaatggtaccaacagaaaccaggaaacgcccctagaactcctgatctatggttcatcctactttgctgagtcgggtccatcaaggttccagtgcaggtgattctggggacagaatcactctcaccatcaccagtctgcaggctagaggtatttagcttaaacttactttctagttacaaacgtagtacgttaacctacgttacccttcgtaccttttccggaccccgttacggggaccctaagttacggttaggacttaacgtactaaaacgtaacgttggtacggtctacgactaccctattccttacgttctttacc

SEQ ID NO: 334862 - DNA, 723 bp, Homo sapiens
  misc_feature: GZ8MTXP02H96HC.52.1.A01.1.454.CMB.2.raw
  modified_base (179)..(179): a, c, t, g, unknown or other
  misc_feature (179)..(179): n is a, c, g, or t
  modified_base (217)..(217): a, c, t, g, unknown or other
  misc_feature (217)..(217): n is a, c, g, or t
  modified_base (261)..(261): a, c, t, g, unknown or other
  misc_feature (261)..(261): n is a, c, g, or t
tcagcgcagtacgacacgaccggtgctcgatttagacgtctcatcagggggagtcagtctcagtcaggacacagcatggacatgagggtccccgctcagctccgtggggctcctgctactctggctccgaggtgccagatgtgtcatccagatgacccagtctccatcctccctgtccncatctgtaggagacagagtcatcatcacttgccggganaagtcagagctaattaagaacgttatttaaatcggtaaccaaanaacgaaaccgaaggaaacgcccctagaactccgtagacttactagtcggttacactcctacttttgcgttaggtacggtcggggtcccctaagttacgtaagggtttacccagggttcggactaagggtggtaacttccggttggggaacctaagtaaactttccaactcctaccaacccacttaccggaaaccctagttcccggtacgaccgtacgggtacgttacgggttaacggtttacgttttaccgaaactttaaaccttttacgtttacgttacggttaaactaaacgttaacggttaacgtttaacccttaccgtttacccttaccgtttaccggtttcccggacccggtacgggtaacctacggttacggttacgtaaacttaacgtaaacgtaaaacgtacggttagtacggtaaccgtacgaccgtactacgttacgttacgtttacttacg

SEQ ID NO: 334863 - DNA, 528 bp, Homo sapiens
  misc_feature: GZ8MTXP02JBVU9.52.1.A01.1.454.CMB.2.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctcctgtccgcatctgtagganacagatcatcatcacttgccggnaagtcagagcattagaacgtatttaaatggtacaanagaaccagggaaaccnccanactctnatntatgtcatctnttgcgtgaggtcggtccagtacgtaggtcgagtgacgtagtgatcgtggactagtactccactcacactactaccgactgtctacgcgtagctaggtacgttattacgacttaactttcttctacgtacaacgtagttaacttactaccgttccctacgtacgttccggaccgtaggactagtagtagaactactaacgaaacgtacgtgtacgctacgtactactactacttcttactc

SEQ ID NO: 334864 - DNA, 532 bp, Homo sapiens
  misc_feature: GZ8MTXP02GO2J5.52.1.A01.1.454.CMB.2.raw
  modified_base (273)..(273): a, c, t, g, unknown or other
  misc_feature (273)..(273): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
tcagcgcagtacgacacgaccggtgctcgatttagacgtctcatcagggggcaggagtcagtctcagtcaggacacagcatggacatgagggtccccgctcagcctcctggggctcctgctactctggctccgaggtgccagatgtgtcatccagatgacccagtctccatccctccctgtccgcatctgtaggagacagagtcatcatcacttgccggcaagtcagagcattagaacgtattaaattgtatacaacagaaaccagggaaacncccctagaactctgatctatgtcatcctactttgctgagtcgggtccatcaagttcagtggcagtggatcgtgggacagattcactcncacatcacagtctgcaggctgagtntttacgactactttacttctagtacaaacgtagtagttacctacgtttccccttacgtaccgtttccggcccgttagggaccctagttaggtacggattaactaacaaaaccgtaagtggttacggcttacggacctacctattcc

SEQ ID NO: 334865 - DNA, 576 bp, Homo sapiens
  misc_feature: GZ8MTXP02FY7MN.52.1.A01.1.454.CMB.2.raw
  modified_base (179)..(179): a, c, t, g, unknown or other
  misc_feature (179)..(179): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgnatctgtaggagacagagtcatcatcacttgccgggcaagtcagagcatagaacgtattaaatgtacaanagaaacaggaanccctagaactctgatctatgtcatcacttgctgagtgggtccatacaggttccagtgacagtgatcgtgggacagtatcactcactaccatcaccagtctgcaggctagaggtatttagactaaactttacttctacgtacaaacgtagtacgtttaacacgtttcccctacgtaccgtttccggacccgttacggggaaccctaacgttagggttaggtaaacttaaacgttaaccgaaaaccgtaaaccgttggttacggaaccgttacggtacccaaacccgttacgtttaccgtttacgtttacctttaccg

SEQ ID NO: 334866 - DNA, 528 bp, Homo sapiens
  misc_feature: GZ8MTXP02JIBR6.52.1.A01.1.454.CMB.2.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccagggactggtgaagccttcggagatcatgtccctnacctgctctgtctctggtnactccatcagcagtgtatactggctggtcgcagccccagggagggttgagtggattgggagtatcgatcacagtgggagcacctacctcgaacccgtcctacacgacctcgagtcgccatactcacagacacgtccaagaaccagttcacctgaggctagaactctgtcgaccgccgcagacacggccgtaatacttatgtagcgcgggacttcgaggggtgatagtagtggactagtattcgtatcttccttacgacctacgtcggggaccaacggggtaacccgtggtccgaccggtctacccg

SEQ ID NO: 334867 - DNA, 502 bp, Homo sapiens
  misc_feature: GZ8MTXP02IAJDP.52.1.A01.1.454.CMB.2.raw
  modified_base (265)..(265): a, c, t, g, unknown or other
  misc_feature (265)..(265): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaatggtaccaacagaaaccaggaaacnccctagaactcctgatctatgtcatcatttgctgagtgggtccatcagttcagtggcagtggatcgtgggacagaattcactctcaccactcacctagtctagcaggctgaggtatttgactaactttacttctgttacaactagtaacgttacacgttccctactacgtttccggccctgggaacctagtagtgaacttacacaaaacgtactggtagcctgcacatcctgttctc

SEQ ID NO: 334868 - DNA, 472 bp, Homo sapiens
  misc_feature: GZ8MTXP02GFF1G.52.1.A01.1.454.CMB.2.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (322)..(322): a, c, t, g, unknown or other
  misc_feature (322)..(322): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (434)..(434): a, c, t, g, unknown or other
  misc_feature (434)..(434): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtattaaatggtacaacagaaaccaggaaancccctgaactcctgatctatggtcatcacttgctgagtgggccatcaagttccagtgnagtggatctggggacagaattcactctcaccatcaccagtctgcaggctgaggtatttgctaaattctntgtacaacagagtacngttcctntacttcgcctggaccatagngatatacaaacgaactgtagctagcacatctcgtctac

SEQ ID NO: 334869 - DNA, 485 bp, Homo sapiens
  misc_feature: GZ8MTXP02I2GPW.52.1.A01.1.454.CMB.2.raw
  modified_base (259)..(259): a, c, t, g, unknown or other
  misc_feature (259)..(259): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcatagaacgtattaatgtaccaacgaaacaggaanccctgaactcctgatctatgtcatccatttgctgagtgggtcccatcaaggttcagtgcagtgatcgtggcagaatcactctcaccatcacagtctgcagctgaggtatttgactaactttacttctgtacaacagtagttacacgttccctctacgtttccgccctaggacctagtacgtaggatagtacaaacgtactgtaggctgcactactctctctactac

SEQ ID NO: 334870 - DNA, 568 bp, Homo sapiens
  misc_feature: GZ8MTXP02FZ4DP.52.1.A01.1.454.CMB.2.raw
  modified_base (215)..(215): a, c, t, g, unknown or other
  misc_feature (215)..(215): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcatagaacgtatttaaatggtaccaacagaaaccagggaaacgcccctagaactcctgatctatggttcatcctatttgctgagtcgggtccatcaaggttccagtgcagtggatcgtgggacagtaactcactctacaccatcaccagtctgcaggctggaggttatttacgacttaacctttacttctacggtacaacgtacggtaattaccacggtttccccttacgtaaccgttttcccggacccgttacggggaaccctacgttacggtacggtaattaaacttaccgaaaacgtaacgtggttacggctacggaccactactcgttacgtactttacc

SEQ ID NO: 334871 - DNA, 584 bp, Homo sapiens
  misc_feature: GZ8MTXP02HAW07.52.1.A01.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (380)..(380): a, c, t, g, unknown or other
  misc_feature (380)..(380): n is a, c, g, or t
  modified_base (443)..(443): a, c, t, g, unknown or other
  misc_feature (443)..(443): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggnaagtcagngctattaagaacgttaatttaaatcggtaaccaacaagaaaccgaagggaacncccctagaactcctagatctagtggtacactcctacttgctggtaggtcgggtcctatcgtaaggtccagtgcaggtgatcgtggacagtatcactcacactanacacctagtcagcgaggtctaggacggttattttcgaccttaaactttctttacgtacgtaanaaccgtaaggttaacttaaccgtccgtttaccctcgttaccggttttcccggccgtacgggtaaccctagtaggttacggaattaacgaacgtaaaacgtacgtggtacggctacgaccaaccttctccgtttctaccttc

SEQ ID NO: 334872 - DNA, 556 bp, Homo sapiens
  misc_feature: GZ8MTXP02ID526.52.1.A01.1.454.CMB.2.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaatgtacaanagaaacaggaacncccctgaactcctgatctatgtcatcctacttgctgagtcgggtcccatnaaggttccagtgcagtgatcgtgggacagtattcactctcactactcaccagtctagcaggctagaggtatttgacttaaactttaccttcttacgtacaaacgtagtacgtttaccacgtttcccctacttaccgtttccggcccgttaggggaaccctagttaggtaggaattaactaaccgaaaacgtacgttggtcggtccttacgacctaacctactttccgtttcgtttaccctttc

SEQ ID NO: 334873 - DNA, 496 bp, Homo sapiens
  misc_feature: GZ8MTXP02F23SP.52.1.A01.1.454.CMB.2.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcatagaacgtattaaatggtaccaanagaaaccaggaancccctgaactcngatctatgtcatcacttgctgagtgggtcccatcaaggtccagtgcagtgatcgtggggacagaattcatctcaccatcaccagtctgcagctgaggtatttgctaaacttacttctgtacaacagtacgttacacgttccctctacgtttcggcccgtgggacctagtagtggtaatactacaaacgtactgtacggctgactaccatcctagtctttac

SEQ ID NO: 334874 - DNA, 607 bp, Homo sapiens
  misc_feature: GZ8MTXP02JUZ67.52.1.A01.1.454.CMB.2.raw
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (367)..(367): a, c, t, g, unknown or other
  misc_feature (367)..(367): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtattaaatggtacaacagaacaggaacnccctagaactcctgatctatgtcatccatttgctgagtcgggtcccatcgtaagttccagtgacagtggatcgtgggacagtattcatctacacatcaccagtcngcgaggtctagaggttatttagacttaaactttctttatcgttaaccaaaacgtacgtaagttaaccgtaaccgtttcccccttacgttaacccgttttccccgggtaccccgttacggggaaccctaggttaacggtacgggtaattaaaccgttaaaccgaaaaacggtaacccgttagggttaccgggcttaccggtaccgaaacccctttacgttccgtttacgttacctttaccg

SEQ ID NO: 334875 - DNA, 487 bp, Homo sapiens
  misc_feature: GZ8MTXP02JJPE3.52.1.A01.1.454.CMB.2.raw
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (425)..(425): a, c, t, g, unknown or other
  misc_feature (425)..(425): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtattaaatgtacaanagaaaccaggaacncccctgaactcctgatctatggtcatcacttgctgagtgggtccatcaagttccagtggcagtggatcgtgggacagaattcactctcaccatcaccagtctgcaggctgtaggtatttcgactaacttacttctgtacaacagtattactacgttccctanacgtttcggaccctgggaccatagtgatagtacaaacgactgtgcgtncacctntctctctc

SEQ ID NO: 334876 - DNA, 572 bp, Homo sapiens
  misc_feature: GZ8MTXP02IM7MV.52.1.A01.1.454.CMB.2.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggcaagtcagagcattagaacgtatttaaatggtaccaacagaaacaggaaacncccctgactcctgatctatgtcatccactttgctgagtcgggtcccatcaggttccagtgcagtgatcgtgggacagaattcactctacaccatcacctagtctgcgaggctaggtaggttatttcgacttaaactttacctttactacgttacaaactagtaacgttacctacgtttcccctacttaccgtttccggacccgttagggaccctagtacggttacggaacttaactaaccgtaaaacgtaccgttagtacgggtaacttacggacctaccgtaactccgtttacgttcctttaacc

SEQ ID NO: 334877 - DNA, 516 bp, Homo sapiens
  misc_feature: GZ8MTXP02G8O9Z.52.1.A01.1.454.CMB.2.raw
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctggtaggagacagagtcatcatcacttgccgggcaagtcagagcattagaacgtattaatgtaccanagaacaggaancccctgaactctgatctatgtcatccatttgctgagtcgggtccatcaaggttccagtgacagtgatcgtggggacagtaattcaactctcacatcaccagtctgcaggctggaggtactttagacttaacttcttactcgttacaactaggtatttacacgttccctactaccgtttccggtccgtagggacctagtagtggacttactacgaaacgtactggtcgaactcgacctacctatcctgttacttcc

SEQ ID NO: 334878 - DNA, 515 bp, Homo sapiens
  misc_feature: GZ8MTXP02GJNRT.52.1.A01.1.454.CMB.2.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (297)..(297): a, c, t, g, unknown or other
  misc_feature (297)..(297): n is a, c, g, or t
  modified_base (392)..(392): a, c, t, g, unknown or other
  misc_feature (392)..(392): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgtatactggctggtcgcngccccaggagggttgagtggattgggatatcgatcacagtgggancacctactcgaacccgtcctcacgacctcgagtcgccatactcacagacacgtaccaagaaccagttctacctgagctagaactctgcgacgccncagcacggccgtaatacttatgtgcgacgggacttcgaggggtgatagtagtgactacgattcgattctcttacgacgttacgcggggccaacggggtaaccctgggtaccaccggtctcccg

SEQ ID NO: 334879 - DNA, 544 bp, Homo sapiens
  misc_feature: GZ8MTXP02HROJ2.52.1.A01.1.454.CMB.2.raw
  modified_base (224)..(224): a, c, t, g, unknown or other
  misc_feature (224)..(224): n is a, c, g, or t
tcagcgcagtacgacacgaccggtgctcgatttagacgtctcatcaggggatgctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactccatcagcagtggttattacgtgggcctgggtccggcacgcccccgaggggaaggggtttgaggtggattggggagtagtcgatcacgaggtgggagcacctacctcgaacccgtccctccacgactcgacgtcgccatctcaacagaccacgtaccaaagaacccagttctaacctgaggctagaactctgtcgaccgccgcagaccacggccgttatatttagtgtgacggcgggtacttcggaggggtgagtagtagtggtctacgtattcgtatctacttgaacgtcgtcgggccaggaccctggtctacccg

SEQ ID NO: 334880 - DNA, 538 bp, Homo sapiens
  misc_feature: GZ8MTXP02JJJ3M.52.1.A01.1.454.CMB.2.raw
  modified_base (267)..(267): a, c, t, g, unknown or other
  misc_feature (267)..(267): n is a, c, g, or t
  modified_base (427)..(427): a, c, t, g, unknown or other
  misc_feature (427)..(427): n is a, c, g, or t
  modified_base (479)..(479): a, c, t, g, unknown or other
  misc_feature (479)..(479): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccgggcaagtcagagcattagaacgtattaaatggtaccaacagaaaccaggaacnccctgaactcctgatctatgtcatcactttgctgagtgggtcccagtcaaggttccagtgacagtgatcgtgggacagtattcactctcacctatcaaccagtctgcgagtcctggaggtatttgacctaaattcttactagtacaacagtacgttaacncttccctagtactttccggcccgttagggaaccctagtaggtacgtattaanaccgtaaaacggtaccttaggtccggaacgtacgacctacctattcctacgttacttcg

SEQ ID NO: 334881 - DNA, 528 bp, Homo sapiens
  misc_feature: GZ8MTXP02HMBY9.52.1.A01.1.454.CMB.2.raw
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtcctccatccctccctgtcccgcatctggtaggagacagagtcatcatcacttggccgggnaagtcagagcattagaacgtattaaatggtaccaacagaaaccgaggaaacncccctagaactcctgatctatgtcatccattgctgagtgggtccatcgaaggttccagtggcagtgatcgngggacagtaatcactctacaccatcaccagtctgcaggctaggaggttntttacgacttaaactttacttgtacgttacaactagtacgttactacgttccctcgttacgtttccggccgttgggacctagtacgtgtaatactaacgaaacgtacttgngtaactgaccactntctcgttactc

SEQ ID NO: 334882 - DNA, 510 bp, Homo sapiens
  misc_feature: GZ8MTXP02GIN55.52.1.A01.1.454.CMB.2.raw
  modified_base (223)..(223): a, c, t, g, unknown or other
  misc_feature (223)..(223): n is a, c, g, or t
  modified_base (421)..(421): a, c, t, g, unknown or other
  misc_feature (421)..(421): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagngcattagaacgtatttaaatggtaccaacagaaaccaggaaagcccctagaactcctgatctatggttcatccatttgctgagtgggtcccatcaaggttccagtgcagtgatcgtgggacagaattcactctacaccatcaccagtctgcaggctgaggtatttgactaacttcttctgtaccaatagtattaaccngtttccctcgtacgtttccggcccttaggggaccctagttagtaggattacgactaaacgtaactgtggctcacaccatctctcttacc

SEQ ID NO: 334883 - DNA, 517 bp, Homo sapiens
  misc_feature: GZ8MTXP02HT89I.52.1.A01.1.454.CMB.2.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (377)..(377): a, c, t, g, unknown or other
  misc_feature (377)..(377): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcatagaacgtattaaatggtaaccaanagaaaccaggaaacncccctagaactcctgatctatggttcatcctactttgctgagtgggtccatcaaggttccagtggcaggtggatcgtggggacagtaaattcatcctacacccatccaccngtctagcgagcgtgagtacttttgactactttacttcgttgtacaacagtacttactacgttccctctacgtttccgcccgtgggacctagtagtgactataccgaaacgtactgtgctgaccacctatcctgttctacc

SEQ ID NO: 334884 - DNA, 512 bp, Homo sapiens
  misc_feature: GZ8MTXP02F51U8.52.1.A01.1.454.CMB.2.raw
  modified_base (139)..(139): a, c, t, g, unknown or other
  misc_feature (139)..(139): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgaaaccngatgtgtcatccagatgacccagtctccatcctccctgtccgcatctgtaggagacagagtcatcatcacttgccgggcaagtcagagcattagaacgtattaaatgtacaanagaaaccaggaaancccctgaactctgatctatggtcatccactttgctgagtgggtccatcaaggtccagtggcagtgatcgtgggacagaattcactctcaccatcaccagtctgcaggctagaggtatttgactaaactttacttctagttacaactaaggtattaaccacgtttccctactactttccggacccttgggaccctagtagtggatatacaaaacgtaactgtaggcctgaccaccatctctctttac

SEQ ID NO: 334885 - DNA, 548 bp, Homo sapiens
  misc_feature: GZ8MTXP02HFEA2.52.1.A01.1.454.CMB.2.raw
  modified_base (221)..(221): a, c, t, g, unknown or other
  misc_feature (221)..(221): n is a, c, g, or t
  modified_base (309)..(309): a, c, t, g, unknown or other
  misc_feature (309)..(309): n is a, c, g, or t
  modified_base (491)..(491): a, c, t, g, unknown or other
  misc_feature (491)..(491): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatcgtccctcacctgctctgtctctggtnactcatcagcagtgttatacgtggccgtggtccgcacgccccgagggaagggtttgaggtggagtgggagtatcgatcacaggtgganccacctacctcgaacccgtcctacacgacctcgactcgcctatactcacacgaacaccgtacaacgaaccacgttacactgacggctacgaacctctgtcgaccgtcgacacgacacggaccgtatatttagtgtggacgcggtacgttcggaggggtgaagttagtaggtcgtactacgtntttcgtatctacgttcgacgtacgcggggacacgggtaccctggacctcgtcctccg

SEQ ID NO: 334886 - DNA, 552 bp, Homo sapiens
  misc_feature: GZ8MTXP02HA6Y5.52.1.A01.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggnaagtcagagcattagaacgtattaaatgtaccaanagaacaggaancccctagactcnatctatgtcatccattgctgaggtcgggtccatcaaggtccagtgcngtgatcgtgggacagacttcactctacacatcacctagtcgncgagctaggtagttatttacacttaactttacttctacgtacaagtagtaacgttacctacgtttccctacgttaccgttccggacccgtacggtaacctaaggtacggttacgtaaactaacgtaaaccgtaaaacgtacgttggtacgaacgtacgacctaccttacgttcgtttacgttactttacg

SEQ ID NO: 334887 - DNA, 521 bp, Homo sapiens
  misc_feature: GZ8MTXP02FT4FN.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactccatcagcagtgtatactggctggtccgcagccccgagggaagggttgagtggagttgggagtatcgatcacagtgggagcacctacctcgaaccccgtcctcacgacctcgagtcgcatatacacagacacgtaccaagaaccagttctacctgacggctagaactctgtcgaccgccgcgacgacacggccaatactattattgtagcgcgggtacttcggaggggtgatagtagtcggctagtacttcgtatctctgactaacgtcgggcgacggaccctggtaccaccgttcc

SEQ ID NO: 334888 - DNA, 523 bp, Homo sapiens
  misc_feature: GZ8MTXP02G9UDV.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttcggagatcatcgtccctcacctgctctgtctctggtnactccatcagcagtgttattactgggcctgggtccgcacgcccccgagggaggggtttgagtggattgggagtatcgatcacagtgggagcacctacctcgaaccccgtccctcacgacctcgagtcgccatatcacagacacgtaccaagaaccagttcctactgagctgaactctgtcgaccgcgacagacacgccgtatattatgtgcgcggtactcgaggggtgatagtagtggtctacggtattcgtatcgtccttagactacgtcgggcacgggtacctggtcctaccgtctcccg

SEQ ID NO: 334889 - DNA, 545 bp, Homo sapiens
  misc_feature: GZ8MTXP02GSHPE.52.1.A01.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (424)..(424): a, c, t, g, unknown or other
  misc_feature (424)..(424): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtagganacagagtcatcatcacttggccggnaagtcagagcattagaacgtatttaaatggtaaccaaaccgaaaccagggaaacncccctagaactcctgatctatggtcactccactttgctgtaggtcggggtcccatcaaggttcagtggcagtgatcgagggcagtaatcactctacacatcaccagtctgccaggtctggaggtatttcgactaactttacttctagtacaanagttacgttacctacgttcccttacgtacgtttccggccgttacgggacctaaggtagtaggtatactaaccgaaacgtaccgtgtcggtactgacctacgactcgtactctttactaccg

SEQ ID NO: 334890 - DNA, 505 bp, Homo sapiens
  misc_feature: GZ8MTXP02GCCGE.52.1.A01.1.454.CMB.2.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtattaaatggtaccaanagaaaccaggaancccctagaactcctgatctatgttcatcctactttgctgagtcgggtccatcaaggttccagtgcagtggatcgtgggacagattcactctcacatcaccagtctgcaggctgagtactttgctaaacttctctgtaccaatagtacgttactacgttcctactaccttcgggcccttgggacctagtagtggacttacacaaaaccggtaacnggttgctcgaccaccttntctcgtctac

SEQ ID NO: 334891 - DNA, 528 bp, Homo sapiens
  misc_feature: GZ8MTXP02FZKWB.52.1.A01.1.454.CMB.2.raw
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtcctccatccctccctgtccgcatctgtaggagacagatcatcatcacttgccggcaagtcagagcattagaacgtattaaatgtacaanagaacaggaaanccctagaactcngatctatgtcatcctatttgctgaggtgggcccatcaaggtccagtgcaggtgatcgtggggacagaattccactctcacatcaccagtcngcgagntagtagttattacgacttaacttctactactacaacgtagtacttaccgtaccttccctacgttccgttccggaccgtacggaactagtagtagtaacttaacgtaacgtaaacgtacgtcggtacgtccgtacgacctactcttctacgttcttacg

SEQ ID NO: 334892 - DNA, 518 bp, Homo sapiens
  misc_feature: GZ8MTXP02IMPW2.52.1.A01.1.454.CMB.2.raw
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (495)..(495): a, c, t, g, unknown or other
  misc_feature (495)..(495): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtaccaacagaaaccaggaaacnccctgaactcctgatctatgtcatcctatttnctgaggtcggggtcccatcgaaggttccagtggcagtgatcgtgggacagaattcactctcacatcacagtctgcagctgaggtatttcgactaaacttacttctagttacaacgtagtagttaccacgtttcccctacgtacgtttccggcccgtagggaccctagtacgtggaactacgtacaaaaccgctagnggtctgctaccatcctgtacttc

SEQ ID NO: 334893 - DNA, 570 bp, Homo sapiens
  misc_feature: GZ8MTXP02G2SMG.52.1.A01.1.454.CMB.2.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactcatcagcagtgttatacnggctggtcgcagccccaggacgggttgagtggagttgggagtagtcgatcacgaggtgggagccacctacctcgaacccgtccacacgacctcgacgtcgccatactacacacgacaccgtaccaaacgaaacctagttacctaaccctgaacggctacgaaactcttgtcgaccggccgacacgacacggccgtaatacttagtgtgcgcggtacgttcgaggggtgagtagtagtcgggtactacgtattacggtattcctaccgttacgacgttacgtcggggaccgaacggggtaacccgtggtaccacccggttctaccccg

SEQ ID NO: 334894 - DNA, 515 bp, Homo sapiens
  misc_feature: GZ8MTXP02IE1BP.52.1.A01.1.454.CMB.2.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (463)..(463): a, c, t, g, unknown or other
  misc_feature (463)..(463): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggccaggactggtgaagccttggagatcatgtccctcacctgctntgtctctggtnactccatcagcagtgttattactggctggtccgcagccccgaggaagggttgagtggattgggagtatcgatcacagtgggagcacctacctgaaaccccgtcccctcacgacctcgagtcgccatatcacagtacacgtaccaagaaccagttcacctgaggctagaactctgtcgaccgcgcagacacggccgtatattatcgtgcgcgggacttcgagggtgatagtagtggactacggtnttctatctacgtcgtactacgtcggaccgacggacctcgtaccacgtctccg

SEQ ID NO: 334895 - DNA, 519 bp, Homo sapiens
  misc_feature: GZ8MTXP02JEULA.52.1.A01.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctcctgtccgcatctgtagganacagagtcatcatcacttgccggnaagtcagagcattagaacgttattaaatgtacaacagaaaccaggaaacncccctagaacctctgatctatggtcatcctattgctgnggtcgggccatcaagtccagtgcagtgatgtgggacaggtattcactctacacatcaccagtctgcaggctaggtacgtatttcgacttaacttcttcgtagtacaacgtagtacgttactacgttacctcgtacgttccgccgtaggacctagtacgtgtaactaatacgaaacgtacgtggtacgctacgacctactattcctcgttacttaccg

SEQ ID NO: 334896 - DNA, 519 bp, Homo sapiens
  misc_feature: GZ8MTXP02GPHYQ.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactccatcagcagtgttatactggctggtccgcagccccaggaagggtttgagtggattgggagtatcgatcacgagtgggagcacctacctcgaacccgtcctcacgacctcgagtcgcatatcacagacacgtaccaagaaccagttacctaccctgacggctaggaactcgtagtcgaccgccgacagaccacggccgtatattagtgtcgcgcgggacttcgaggggtgatagtagtggctacgattcgtatctctacgcttagcgggcagggtaccctggccaccgtctcccg

SEQ ID NO: 334897 - DNA, 494 bp, Homo sapiens
  misc_feature: GZ8MTXP02G9F17.52.1.A01.1.454.CMB.2.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagagtcatcatcacttgccggnaagtcagagcattagaacgtattaaatggtaccaacgaacaggaanccctagaactcngatctatgtcatccatttgctgagtgggtcccatcaaggttcagtgcagtgatcgtgggcagaatcactctcacatcacagtcngngngntgagtattnactacttatntgacatagtacgtactcgttcctctacgttcgccgtagactagtacgtagtatacgtaacgaaacgtacgtcgtacgacgtcgtacctacctacttcttcgttaccttactac

SEQ ID NO: 334898 - DNA, 523 bp, Homo sapiens
  misc_feature: GZ8MTXP02JEY84.52.1.A01.1.454.CMB.2.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccgganaagtcagagctatagaacgtattaaatgtaccaanagaacaggaaacnccctagaactccagatctatgtcatcctattgctgagtcggggtccagtacgaaggttccagtggcagtgatcgtggggacagtaacttcactctacacatcacagtctgccgagctagagttatttcgactaacttcttctacgtacaacagtagttaactacgttccctactaccgtttccgcccgtgggaacctagtaggtagtactaacaactaaacgtaactcggtagcgtcgacctaactatctcgtactac

SEQ ID NO: 334899 - DNA, 524 bp, Homo sapiens
  misc_feature: GZ8MTXP02HOLLL.52.1.A01.1.454.CMB.2.raw
  modified_base (221)..(221): a, c, t, g, unknown or other
  misc_feature (221)..(221): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (394)..(394): a, c, t, g, unknown or other
  misc_feature (394)..(394): n is a, c, g, or t
  modified_base (472)..(472): a, c, t, g, unknown or other
  misc_feature (472)..(472): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactccatcagcagttgttattactggggcctgggtccggcagcccccgaggggaaggggtttgaggtggatttggggagtatcgatcacagtgggancacctactgaacccgtcctcacgcctcgagtcgcatatcancgacactccaaagacagttcactgagctagaactntgtcgaccgccgcagccacggccgttatatttactgtagcgtacggacttcggaggggtgatagtagtggtactagtnttacgtattctcttgactacgtgggaccagggaccctgtccacgttctcccg

SEQ ID NO: 334900 - DNA, 514 bp, Homo sapiens
  misc_feature: GZ8MTXP02IULHV.52.1.A01.1.454.CMB.2.raw
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (347)..(347): a, c, t, g, unknown or other
  misc_feature (347)..(347): n is a, c, g, or t
  modified_base (453)..(453): a, c, t, g, unknown or other
  misc_feature (453)..(453): n is a, c, g, or t
tcagcgcagtacgacacgaccggtgctcgatttagacgtctcatcagggggctttctgagagtcatggacctcctgtgcaagaacatgaagcacctgtggttttcctcctgctggtggcagctcccagatgggtcctgtcccacgtgcagctgcaggagtcgggcccaggactggtgaagccttggagatcatgtccctcacctgctctgtctctggtnactcatcagcagtgtatatggctggtccgncgccccgagggagggttgagtggatgggagtatcgatcacaggtggagccacctacctcgaaccccgtcctacacgacctcgacgtcgccatatcacnacacgtaccaagaactagtctaccgtgacggctagaactctagtcgaccgccgacagaccgacggcctaatacttatgtgcgcggacttgaggggtgagtatacgnggactagattcgtatcgtcctagtctacgtggccgacggtacccgtggtacaccgtctccg

SEQ ID NO: 334901 - DNA, 490 bp, Homo sapiens
  misc_feature: GZ8MTXP02GF7QX.52.1.A01.1.454.CMB.2.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
tcagcgcagtacgacacgaccggtgctcgatttagacgtctcatcagggggctttctgagagtcatggacctcctgtgcaagaacatgaagcacctgtggttttcctcctgctggtggcagctcccagatgggtcctgtcccagtgcagctgcaggagtcgggcccaggactgggtgaagccttggagatcatgtccctnacctgctctgtctctggtnactcatcagcagtgtatactggctggtcgcagccccgaggaagggttgagtggatgggagtatcgatcacagtggagcacctacctgaacccgtcctcacgcctcgagtcgcctatatcacagacacgtccaagaacagttctacctgaggctgaactctgtcgaccgcgcagacacggcctatattatgtcgcgcggacttcgaaggggttgatagtagtgctacgattcgtatctcttgactagtgggcaggaccctggtcacgtctcc

SEQ ID NO: 334902 - DNA, 531 bp, Homo sapiens
  misc_feature: GZ8MTXP02JNRLM.52.1.A01.1.454.CMB.2.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
tcagcgcagtacgacacgaccggtgctcgatttagacgtctcatcaggggatgctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatcgtccctnacctgctctgtctctggtnactccatcagcagtggttatactggcctggtccgcacgcccccagggacgggttgagtggagttgggagtagtcgatcacgaggtgggagcacctacctcgaaccccgtcctaccacgactcgacgtcgccatctacaacagacacgtacaacgaaccagttctacctgagctagactctgtcgaccgccgcagacacggccgtatattatgtgcgcgggtactcgaggggtgtagtagtagtggctacgtattcgtactctcgttgaacgttcgacgggaccgtacggaacccgtcggtacctaccg

SEQ ID NO: 334903 - DNA, 597 bp, Homo sapiens
  misc_feature: GZ8MTXP02JPJIX.52.1.A01.1.454.CMB.2.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
  modified_base (370)..(370): a, c, t, g, unknown or other
  misc_feature (370)..(370): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagatcatcatcacttggccgggcaagtcagagctattagaacgttatttaatggtaaccaacaagaaaccgaagggaacncccctagaacctctagtatctatggtacactcctactttgctggacggttcgggtaccctagtacgtaaggttccaggttggactaggtggattcggnggggaactaggtaacttccacttcacacctatccacccgtagtctagcgaggtcgtagaggttatttacgacttaacttcttctagtaccaatacggtaattacctacgttcccctagtaccgtttccggaccccgttagggaccctaagttacggtacggtaaacttacgtaaacgaaacgtaacgttggcggtaactcgactacctatcgttacgtcctttaacg

SEQ ID NO: 334904 - DNA, 610 bp, Homo sapiens
  misc_feature: GZ8MTXP02HWWFI.52.1.A01.1.454.CMB.2.raw
  modified_base (216)..(216): a, c, t, g, unknown or other
  misc_feature (216)..(216): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttggccgggnaagtcagagctaattagaacgtaatttaaatggtaaccaacaacgaaaaccgaaggaaacgcccctagaacctcctagactctatggttacactcctactttgcgtaggtaggtcggggtccctagtcgaaaggttccaggtggcaggtgatcgtgggacagtaatcactctcacatcacagtcngcaggtctgaaggtatttcgacttaaactttacttntacgttacaaacgtagtacgtttaactacgtttacccctacgttacccggttttccggaccccgttacggggaaaccctaggttaaggtacggaaattaaacgtaaccgtaaaaacgaaccgttggtaccggtcgtacgacctacccgtattccgttacgtttccctttaccg

SEQ ID NO: 334905 - DNA, 496 bp, Homo sapiens
  misc_feature: GZ8MTXP02FHWNW.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactccatcagcagtgtatactggctggtcgcagccccaggaggttgagtggatgggatatcgatcacagtgggagcacctacctcgaacccgtcctcacgacctcgagtcgcatatcacagacacgtaccaaagaaccagttactacctgaggctagaactcgtgcgaccgccgcacgacacggccgtatacttatgngcgcgggattcggagggtganatagnggctacgnttcgatctctgactagtcggcacggacctggtcaccgtctccg

SEQ ID NO: 334906 - DNA, 500 bp, Homo sapiens
  misc_feature: GZ8MTXP02HY8HH.52.1.A01.1.454.CMB.2.raw
  modified_base (221)..(221): a, c, t, g, unknown or other
  misc_feature (221)..(221): n is a, c, g, or t
  modified_base (425)..(425): a, c, t, g, unknown or other
  misc_feature (425)..(425): n is a, c, g, or t
  modified_base (476)..(476): a, c, t, g, unknown or other
  misc_feature (476)..(476): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactccatcagcagtgttatactggctggtcgcagccccaggaggttgagtggattgggatatcgatcacagtgggagcactacctcgaacccgtccctcacgacctcgagtcgaccatactcacagacacgtccaaagaaccagttcctacctgaggctgaactctgtcgaccgcgcacgacacggtccgtatattatgtgcgnggactcggagggtgatagtagtgctacgattctagtctccttagacttagnggccagggacctggccacgtctcc

SEQ ID NO: 334907 - DNA, 581 bp, Homo sapiens
  misc_feature: GZ8MTXP02G5GHB.52.1.A01.1.454.CMB.2.raw
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctgtnactccatcagcagtgttattacgtgggctgggtccgcacgccccgagggtaggtttgagtggagttgggatntcgatcacgagtgganccactacctcgaacccgtcccacacgaccctcgacgtcgcatacncacgacacacgtacaacgaacctgttactacctagacggctacgaacttgtacgtacgacccgccggacacgaccgaccgggtccttaattactttagtcgttcggacgtcggtacttcgggagggtagtatagtagtcggtacgtacgttagttcgtatccgttcgttacgaccgttacggtcggggaccgtaacgggtacccgtgtaccgtacccgttctccccg

SEQ ID NO: 334908 - DNA, 515 bp, Homo sapiens
  misc_feature: GZ8MTXP02I2NY2.52.1.A01.1.454.CMB.2.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (340)..(340): a, c, t, g, unknown or other
  misc_feature (340)..(340): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcatagaacgtattaatgtacaanagaacaggaacncccngactctgatctatgtcatcacttnctgagtcgggtccatcaggtccagtgcagtggatcgtgggacagtaatcactcncaccatcacctagtctgcaggctagagtattgactaacttcttctacgtacaactagtacgttactacgttcccttacgtaccgtttccggccgtagggtacctagtacggtagacttactacgaaaaccgtaacgttcggtaggaactcgacctactacgtctcgttactttac

SEQ ID NO: 334909 - DNA, 601 bp, Homo sapiens
  misc_feature: GZ8MTXP02G70YT.52.1.A01.1.454.CMB.2.raw
  modified_base (218)..(218): a, c, t, g, unknown or other
  misc_feature (218)..(218): n is a, c, g, or t
  modified_base (321)..(321): a, c, t, g, unknown or other
  misc_feature (321)..(321): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccggganaagtcagagctaattagaacgttaatttaaagttaggtaaccaaacaagaaaccgaagggaaacgcccctagacctcctagatctatgttcactcctatttgntgaggtcgggtaccatcgaaggtcaggtgacagtggtatcgtgggacagtacttcactctacacctactaccacccgtagtcgtgacgacggtctaggtaggttatttacgacttaaacctttcgttacgtcgtaacaaacgtacgttaacgttacccgtacgtttcccctacgttaccgtttcccgggacccgttagggaaccctaagttacggtagtaacttaacgtaccgaaaacgtacgtggtacggctcgacctacctcttcgtcgttacttacc

SEQ ID NO: 334910 - DNA, 545 bp, Homo sapiens
  misc_feature: GZ8MTXP02GD8YD.52.1.A01.1.454.CMB.2.raw
  modified_base (223)..(223): a, c, t, g, unknown or other
  misc_feature (223)..(223): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccagggactgggtgaagccttcggagatcatgtccctcacctgctctgtctctggtnactcatcagcagtgtatactggctggtccgcagccccgagggagggttgagtggatgggagtatgatcacgagtgggagcacctacctcgaacccgtcctcacgacctcgagtcgcatatacacagacacgtccaagaacagttcacctgagctagactctgtcgaccgcgcagacacggctatattatgtggcgtcggacttcgaggggtgatagtagtcggacgttacgatttcggtaactcttccgttacgtaaccgttacggtaaggggtccgtaacgggggtaacccttcggggtcctaacccggttccgttccccg

SEQ ID NO: 334911 - DNA, 557 bp, Homo sapiens
  misc_feature: GZ8MTXP02GDZHA.52.1.A01.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccggnaagtcaganctattagaacgttatttaaatggtaccaanagaaaccaggaaacncccctagaactcctgatctatggttcatcctactttgctgaggtcgggtcccatcaaggttccagtgcagtgatcgtgggacagtattcactctacacctatcacctagtctgctaggctaggtaggttatttagacttaaactttaccttgtacgttaaccaacgtacggttaagtttaccacgtttccccctacgttacccgtttccggaccccgtagggtaccctagtacgtaggtactacgtacgaaacgtacgtgtcggaatcgactacgtactctactcttac

SEQ ID NO: 334912 - DNA, 604 bp, Homo sapiens
  misc_feature: GZ8MTXP02IT3IN.52.1.A01.1.454.CMB.2.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccacgtgcagctgcaggagtcgggcccaggactggtgaagccttcggagatcatgtccctcacctgctctgtctctggtnactccatcagcagtgttattactgggctgggtccgcncgccccgagggaagggttgaggtggagttgggagtagtcgatcgaacgaggtgggagccacctaccgtacgaaccccgtccctacgaccgtaccctacgacgtccgaccattacacacgacgaccgaaccgtaccaaaacgaaccgtacgttacctaccgtaggacgactacgaacttcgtagtcgaccgccgacacgacaccgggtccttaatacgtttagtcgtagccgacgggtacttcggaggggtgtatagtaggtcggtactacggtacttcgtattccttcgttacgccgttaacggtcggggaccacgggtacctaggactcccgtaacggttcccg

SEQ ID NO: 334913 - DNA, 567 bp, Homo sapiens
  misc_feature: GZ8MTXP02IOZJB.52.1.A01.1.454.CMB.2.raw
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtcccgcatctgtaggagacagagtcatcatcacttgccggcaagtcagagcatagaacgtattaaatgtacaanagaacaggaacncccctgaactctgatctatgtcatctacttgctgagtcgggtccatcaaggtcagtggcagtgatcgtggggacagtaatcactctacaccactcacccagtctgcgagcgtagtaggtatttagcttaaactttacttctacgtacaacgacgtaacgttaccgtacgttccctacgtaccgtttccgggaccccttaggggaaccctaagtacggtagggtaaacttaactaacctaaaacgtaaccgtaggttacggccttacggacctaaccctaagtttccgttacgtttccctttaaccg

SEQ ID NO: 334914 - DNA, 627 bp, Homo sapiens
  misc_feature: GZ8MTXP02JLNWT.52.1.A01.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttcggagatcatcgtccctcacctgctctgtctctggtnactcatcancagtgttatactgggcctggtccgcacgccccgagggtacgggttggaggtggagttgggagtagtcgatacgacgtaggtggggacgccgaaccttaccgtaccgtaaacccccgtccctaccgacgtacccgtcgacgtccgaccatactacacacactaccgtaccaacgtaaccacgttaccctacgtcggaggtactacggaacttcgtagtaccgacccgcccgacacgaccgacggccgttaattattagttgtacggtcggacggtacgtcggtaggggtgtatagtggtacgtacgtacgtagttacgtactccgttcttacgtacgttaccggtaacgggtcccgtaacgggtaacccgtcggtaccgtacccgttcttaccccg

SEQ ID NO: 334915 - DNA, 521 bp, Homo sapiens
  misc_feature: GZ8MTXP02IS1MR.52.1.A01.1.454.CMB.2.raw
  modified_base (190)..(190): a, c, t, g, unknown or other
  misc_feature (190)..(190): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggcaagtcagagcattagaacgtatttaaatggtaccaanagaaaccaggaaacncccctagaacctcctgatctatggtcatcctactttgctgagtggggtcccatcaaggtcagtggcagtgatcgtggggacagatcactctcacatcacagtctgcagctagaggtatttgacttaacttacttctagttacaatagtagttactacgttccctactacgttccggccgtcgggacctagtacgtaggactacgttaacaaacgtaacgtgtacggtctacgactacccatcctacgttcttac

SEQ ID NO: 334916 - DNA, 523 bp, Homo sapiens
  misc_feature: GZ8MTXP02GI2T8.52.1.A01.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggnaagtcagagcatagaacgtattaatgtacaanagaacaggaanccctgactcngatctatgtcatcctattgctgaggtgggtacccatcgtaaggttccagtggcaggtgattcgngggacagtaattcactcncacatcaccatctgcaggctaggacggttatttacgacttaaactttacttcttcggtacaacgtagtacgttactacgttccctctaccgtttccggaccccgtagggaccctaagttacggtagtatacgtacaaaacgtactgtgaacgtcgacactatcctgttacttc

SEQ ID NO: 334917 - DNA, 615 bp, Homo sapiens
  misc_feature: GZ8MTXP02IIILU.52.1.A01.1.454.CMB.2.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctcctgtccgcatctgtaggagacagagtcatcatcacttggccgggnaagtcagagctaattagaacgttaatttaaattggtaaccaaacaagaaaccgaagggaaacncccctagaactcctagatctagtgttcatcctactttgctggtaggtcggggtcccagtcgtaaggttcccaggtggcaggtggatcgtgggaacagaacttcactcncaccatcacctagtctgngagctagaggttntttagacttaaacgtttcttactagtaccaatagtacgttacacgtttccctacgtaccgtttccggcccgtacgggtaacccttaggtacggttaggtaaacttaacgtaaaccgtaaaaacggtaaccgtttaggacggggtaaccttacggaccctaaacccgtatttaccggtttcgtttaccgttttaacccg

SEQ ID NO: 334918 - DNA, 502 bp, Homo sapiens
  misc_feature: GZ8MTXP02H8SUI.52.1.A01.1.454.CMB.2.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (311)..(311): a, c, t, g, unknown or other
  misc_feature (311)..(311): n is a, c, g, or t
  modified_base (454)..(454): a, c, t, g, unknown or other
  misc_feature (454)..(454): n is a, c, g, or t
tcagcgcagtacgacacgaccggtgctcgatttagacgtctcatcaggggatgctttctgagagtcatggacctcctgtgcaagaacatgaagcacctgtggttttcctcctgctggtggcagctcccagatgggtcctgtcccacgtgcagctgcaggagtcgggcccaggactggtgaagccttcgganatcatgtccctnacctgctctgtctctggtnactcatcagcagtgtattactggcccgggtcgcacgccccaggagggttgagtggattgggagtatcgatcacagtggagcacctaccngaaccccgtccctcaccgactcgagtcgccatatcaaacagacacgtccaagaaccagtcacctgagctgaactctgtcgaccgccgcagacacggccgtattagttatgtgcgcggattcgagggtggatagagtggctagnttcgtatcgtcttgctaagtgggacctacgggacctcgggcaccgtcc

SEQ ID NO: 334919 - DNA, 578 bp, Homo sapiens
  misc_feature: GZ8MTXP02FICJA.52.1.A01.1.454.CMB.2.raw
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagctatagaacgtattaaatggtaccaanagaaaccaggaacncccctagaactcctagatctatggttcatccactttgctgaggttcgggtcccataccgtaaggttccagtggacaggtgattcgngggacagtattcactctacacccatccactactctgcgtaggctaggaaggtttnttacgacttaacttacttcgttacgtacgtaacgtacgttacgttaaccgtacgttccctacgttaccgttccggaccgtacggtaacctaagtacggtagtaaactaacgtaacgtaaaaccgtacgtaggtacgtaacgtacgacctactacgttcgttacgttcttacg

SEQ ID NO: 334920 - DNA, 529 bp, Homo sapiens
  misc_feature: GZ8MTXP02HI6RM.52.1.A01.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (416)..(416): a, c, t, g, unknown or other
  misc_feature (416)..(416): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtagganacagagtcatcatcacttgccggnaagtcagagcatagacgtattaatgacanagaacaggaacncccagactctgatctatgtcatcctatttgctggaggtcgggtaccctagtacgtaaggttcccgagtgcaggtggatcgtgggacagtacttcacttcacaccatccacctagtctgcgagctgaggttctttgacttaaacttcttcgtctacaaagngttaacgttactacctttccctcgtaccgtttccgccgttacgggacctagtagtacgaattacgtacaaaacgtcgttcggacgctcgaccactacttctacgttccttacc

SEQ ID NO: 334921 - DNA, 569 bp, Homo sapiens
  misc_feature: GZ8MTXP02FYV56.52.1.A01.1.454.CMB.2.raw
  modified_base (216)..(216): a, c, t, g, unknown or other
  misc_feature (216)..(216): n is a, c, g, or t
  modified_base (398)..(398): a, c, t, g, unknown or other
  misc_feature (398)..(398): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagctattagaacgttattaaatggtaccaacgagaaaccgaggaaacgcccctagaacctcctgatctatggtcatcctattgctgaggtcgggtccatcgaaggtcagtgcagtgatcgtgggacagtaattcactctacacactacaccctagtctgcgagcgtagtaggttnttttacgacttaacttacttctcgtacaacgtagtacgttacacgtttcctcgttaccgtttccggacccttacgggacctagtagggtacgtacttaaacgtaccgtaaaacgtaccgttggtacgtccgttacgaccgtaccgtacttccggttacgtttctttacccg

SEQ ID NO: 334922 - DNA, 570 bp, Homo sapiens
  misc_feature: GZ8MTXP02HRLS4.52.1.A01.1.454.CMB.2.raw
  modified_base (224)..(224): a, c, t, g, unknown or other
  misc_feature (224)..(224): n is a, c, g, or t
tcagcgcagtacgacacgaccggtgctcgatttagacgtctcatcaggggatgctttctgagagtcatggacctcctgtgcaagaacatgaagcacctgtggtttttcctcctgctggtggcagctcccagatgggtcctgtcccacgtgcagctgcaggagtcgggccccaggactggtgaagccttcggagatcatgtccctcacctgctctgtctctggtnactccatcagcagtggttattacgtgggcctgggtcccggcacgcccccgaggggtaaggggtttgaggtggagttggggagtatcgatcacgaggtgggagcacctacctcgaaccccgtccctccacgactcgacgtcgaccatcgtcaaacagaccacgtaccaaacgaaccagttctaccgtgaggctagactcttgcgaccgccgcagaccacggtacgttatattagttgtgccggtcgggtacttcggaggggtgtatagtagtggtcctaggtacttcgtactcttccgttgaacgtacggtcgggggtaccacgggacccttcgggtacctacccgg

SEQ ID NO: 334923 - DNA, 535 bp, Homo sapiens
  misc_feature: GZ8MTXP02HMQ4Y.52.1.A01.1.454.CMB.2.raw
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
  modified_base (439)..(439): a, c, t, g, unknown or other
  misc_feature (439)..(439): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactccatcagcagtgttatactggctggtcgcagccccgaggaggttgagtggagtggagtatcgatcacaggtgggancacctactcgaaccccgtcctcacgacctcgagtcgacatactacacagacacgtaccaaagaaccagttcacctgagctagaactctagtcgaccgcgacacgacacggccgtatattagtgtagcgcggtacttggngggtgatagtagtggacctaggtattacgtatcttccgtagtaccgtacgtcggggtacctaacggggtaaccctcgtacccgtaccttcgtcccg

SEQ ID NO: 334924 - DNA, 548 bp, Homo sapiens
  misc_feature: GZ8MTXP02GQDQK.52.1.A01.1.454.CMB.2.raw
  modified_base (223)..(223): a, c, t, g, unknown or other
  misc_feature (223)..(223): n is a, c, g, or t
tcagcgcagtacgacacgaccggtgctcgatttagacgtctcatcagggggctttctgagagtcatggacctcctgtgcaagaacatgaagcacctgttggtttttcctcctgctggtggcagctcccagatgggtcctgtcccacgtgcagctgcaggagtcgggcccaggactggtgaagccttcggagatcatcgtccctcacctgctctgtctctggtnactccatcagcagtgttattactgggcctgggtccgcacgccccgagggaagggtttgaggtggattgggagtagtcgatcacaggtgggagcacctacctcgaacccgtcctcacgacctcgagtcgccatactacacagaacacgtaccaaacgaaccagttacctacctgacgctagaactctgtcgaccgccgacagacgacggccgtaatacttatgtgcgcggtattcgaggggtgatagtagtgctagtattcgtatcttaccgttgaccttacggtcgggtccgaacggggtaccctggtaccaccggttcttcccg

SEQ ID NO: 334925 - DNA, 584 bp, Homo sapiens
  misc_feature: GZ8MTXP02JASK4.52.1.A01.1.454.CMB.2.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
  modified_base (337)..(337): a, c, t, g, unknown or other
  misc_feature (337)..(337): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctcctgtccgcatctgtagganacagagtcatcatcacttgccgggnaagtcagagctattagaacgttattaaatcggtaaccaaccgaaacagggaaacncccctagaactcctagatctatgtcatcctatttgctgagtgggtcccatcaagttcagtgacagtgntgtggacagaaatcgactctacacatacacagtctagcaggctggagtatttacgacttaactttacttacgttagtaacaacgtacgttaagttaacctacgttccccctagttaacccgtttccgggacccttaggggtaaccctagtacggttaggaacttaacgttaaaccgaaaacggtaacttggtacgggttaacctaacgaacctaccgtacttccgttacgtttacctttacctaccg

SEQ ID NO: 334926 - DNA, 558 bp, Homo sapiens
  misc_feature: GZ8MTXP02HGKPL.52.1.A01.1.454.CMB.2.raw
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctcctgtccncatctgtagganacagagtcatcatcacttgccgggacaagtcagagcattaagaacgttatttaaagtggtaaccaaanaacgaaaccgaaggaaacgcccctagaactccagatctatggtcatcctatttgctagagtcgggtccatctaaggttccagtgacgtagtgatcgtgggacagtaattcactcacacatcacagtctgcaggctgtaggtatttcgactaaactttacttctacgttaacaactaggtaaacttcgtaccgttccccttagtaccgtttcccggaccccgttaggaaacctagtaaggtggaaatacgttaaacaaaacgtacttggcggtctacgcctaactattccgttcttacttcc

SEQ ID NO: 334927 - DNA, 560 bp, Homo sapiens
  misc_feature: GZ8MTXP02G93L3.52.1.A01.1.454.CMB.2.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
  modified_base (390)..(390): a, c, t, g, unknown or other
  misc_feature (390)..(390): n is a, c, g, or t
  modified_base (444)..(444): a, c, t, g, unknown or other
  misc_feature (444)..(444): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcaattagaacgtattaaatggtaaccaaaccgaaacagggaaacncccctagaacctctgatctatcggttcactcctactttgctggtaggtcggggtcccatcgaaggttcagtgcagtggtatcgtgggacagtaacttcactctacaccactcaccagttcncgcaggctagagttatttgactaactttactctagtacaactagtacgttaacncgtttccctagttaccgtttccggcccgtagggaccctaggttacgtaggtaataacgttacgaaaaccgttaccgtggtcggtactgacctacctacgtctacgttcttactccc

SEQ ID NO: 334928 - DNA, 654 bp, Homo sapiens
  misc_feature: GZ8MTXP02FZOP7.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatcgtccctnacctgctctgtctctggtnactcatcagcagttgttattacgtgggccgtgggtccgcacgcccccgagggtaaggggtttgaggtggtagtgggagtagtcgatcacaggtgggagccacctaccgtcgaaaccccgtcctacacgacctcgacgtcgaccatactacacacgacacgtaccaaacgaacctacgttacctaaccgtgacggctacgtaaactcgtagtcgaccgccgacaacgaccgacgggcccgttaattacgttaattggttcggccggacgggtactttacggagggggttagaagtagtaggtcggtacgttacggtacgtttacggttaacgttcctttaccgttacggtaacgttaccggttcgggggaacccgtaaaccgggggtaaacccccgttcgggttacccgtaacccggttcccgtttaacccccg

SEQ ID NO: 334929 - DNA, 567 bp, Homo sapiens
  misc_feature: GZ8MTXP02HRTY3.52.1.A01.1.454.CMB.2.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (378)..(378): a, c, t, g, unknown or other
  misc_feature (378)..(378): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagctattagaacgtatttaaatcggtaaccaaacgaaaccagggaaacncccctagaactctgatctatgtcatcctactttgctgaggtgggtcccatcgtaaggtcagtggacagtggatcgtgggacagaattcactctcactatcacagtcngcagctagagttatttgactaacttactttctagttactaaacgtagtaacttaaccgactttccccgtacttacgtttcccggacccgttaggggaccctaagttacggtacggtaaacttacgtaaccgaaaacgttaccgtggtaccggtctaacgctaacctacttacgttcgttacttacctac

SEQ ID NO: 334930 - DNA, 515 bp, Homo sapiens
  misc_feature: GZ8MTXP02JCHG2.52.1.A01.1.454.CMB.2.raw
  modified_base (260)..(260): a, c, t, g, unknown or other
  misc_feature (260)..(260): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcattgccgggcaagtcagagcatagaacgtattaatggtaccaacgaaacaggaaanccctagaactcctgatctatgtcatcctatttgctgaggtcgggtcccatcaaggttcagtgcagtgatcgtgggacagaattcactctacacatccaccagtctgcaggctggagtagtttcgacttaaacttcttctagtactaacagtacgttaacacgtttccctactaccgtttcgcccttagggacccagttacgtaggtactacgtacaaacgtactcggtgctgacactactcctgttccttactcc

SEQ ID NO: 334931 - DNA, 490 bp, Homo sapiens
  misc_feature: GZ8MTXP02FTIAA.52.1.A01.1.454.CMB.2.raw
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaatagaacgtattaaatggtaccaanagaaacaggaacgccctgaactcngatctatgtcatctactttgctgagtcgggtccagtcaaggtccagtgcgagtggatcgtgggacagattcactctcacatcacngtcngcagcngagtatttgactaattactntagtacaactagtattacacgttcctcgtacttcgaccgtcgggacctagtagtgataatacaaacgtacgtgtggaactgactacctatctctcttacc

SEQ ID NO: 334932 - DNA, 602 bp, Homo sapiens
  misc_feature: GZ8MTXP02F99EY.52.1.A01.1.454.CMB.2.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (306)..(306): a, c, t, g, unknown or other
  misc_feature (306)..(306): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtcccctnacctgctctgtctctggtnactccatcagcagtgtattactggctggtccgcacgccccgagggagggtttgagtggagtgggagtatcgatcacagtgggancacctacctcgaacccgtcctcacgacctcgagtcgacctatactcacacgacacgtaccaaacgaaacctacgttacctaaccctagacggtactacgtaaacttcgtgtccgaccgcccgacacgacgaccggccgtatattagttgtacggcggacggtaccgtggagggggtagagttagtaaggtcggtacgtaccggtaatttcggtaattccttaccgtttagacccttaacggtcggggacccgaacggggtaaacccctcggggtacctacccggttccttaccccg

SEQ ID NO: 334933 - DNA, 500 bp, Homo sapiens
  misc_feature: GZ8MTXP02JCN2J.52.1.A01.1.454.CMB.2.raw
tcagcgcagtacgacacgaccggtgctcgatttagacgtctcatcagggggagtcagtctcagtcaggacacagcatggacatgagggtccccgctcagctcctggggctcctgctactctggcttcgaggtgccagatgtgtcatccagatgacccagtctccatcctccctgtccgcatctgtaggagacagagtcatcatcacttgccgggcaagtcagagcattagaacgtattaaatggtacaacagaaaccaggaaagcccctgaactcctgatctatggtcatccatttgctgagtggggtcccatcaaggttccagtggcagtggatctggggacagaattcactctacacatcaccagtctgcaggctgaggtatttgactaacttacttctgtacaacagtagttacagttccctctacgtttcgcccttgggacctagtacgtaggactatacgaaaacgtaactggtgctgcacctatcgtctctttc

SEQ ID NO: 334934 - DNA, 518 bp, Homo sapiens
  misc_feature: GZ8MTXP02IRFZY.52.1.A01.1.454.CMB.2.raw
  modified_base (221)..(221): a, c, t, g, unknown or other
  misc_feature (221)..(221): n is a, c, g, or t
  modified_base (385)..(385): a, c, t, g, unknown or other
  misc_feature (385)..(385): n is a, c, g, or t
  modified_base (461)..(461): a, c, t, g, unknown or other
  misc_feature (461)..(461): n is a, c, g, or t
  modified_base (512)..(512): a, c, t, g, unknown or other
  misc_feature (512)..(512): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatcgtccctcacctgctctgtctctggtnactcatcagcagtgtattactggcctggtccgcagcccccgagggacgggttgagtggagttgggagtagtcgatcaacgagtgggagcctacctaccgtcgaaaccccgtccctcaccgacctcgagtcgccatatcacagacacgtccaagaacagtctacngagcagactctagtcgaccgccgacagcgacgccgtaatacttattgagcggcggacttcggaggggtgatagtgngctagattcgtatctctcgactacgtggacgacggtaccgtgtccgtaccncgtccc

SEQ ID NO: 334935 - DNA, 627 bp, Homo sapiens
  misc_feature: GZ8MTXP02HCNY8.52.1.A01.1.454.CMB.2.raw
  modified_base (109)..(109): a, c, t, g, unknown or other
  misc_feature (109)..(109): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
tcagcgcagtacgacacgaccggtgctcgatttagacgtctcatcaggggatgctttctgagagtcatggacctcctgtgcaagaacatgaagcacctgtggttttccncctgctggtggcagctcccagatgggtcctgtcccagtgcagctgcaggagtcgggcccaggactggtgaacgccttcggagatcatcgtccctcacctgctntgtctgtggtnactccatcagcagtggttattacgtgggcctgggtccggcacggcccccgaggggtaagggtttgaggtggtagttggggagtatcggatcgaacgaggtgggagcacctacctcgaacccgtcctaccacgactcgacgtcgaccatctacaaacagaccaccgtacaaacgaaaccctacgttcctacccgtaggaacggtctacgtaaactcgtggtacgacccgccgacgaagaccgacggaccgttatacttagttgcgcggtccgggtagtcggagggggtagagtaggtacggtggtacgtacggtaattcggtacttccgttaccgttaggtaacccgtttaacggtccgggggaccgtacggggtaaaccccgttcgggtaaccgttacccccgg

SEQ ID NO: 334936 - DNA, 557 bp, Homo sapiens
  misc_feature: GZ8MTXP02GF2TV.52.1.A01.1.454.CMB.2.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (404)..(404): a, c, t, g, unknown or other
  misc_feature (404)..(404): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgtatactggctggtccgcngccccgaggagggtttgagtggagttgggatagtcgatcacagtgggancacctaccgtcgaacccgtcctcacgacctcgagtcgccatactcacagacacgtaccaacgaaccagttcctactgaggctagaactctgtcgaccgccgnacgacgacggccgttaatatttacgttgtggacggcggtacttcgagggggtgagtagtagtgctaacgtagttcgtaagtcttccgttacgacctttacggcgggggaccgtaacggggtaaccccgtgggtaccctaccggtccttccccg

SEQ ID NO: 334937 - DNA, 543 bp, Homo sapiens
  misc_feature: GZ8MTXP02GYPK2.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttcggagatcatcgtccctcacctgctctgtctctggtnactccatcagcagtgttattactgggcctggtccgcagccccgaggagggttgagtggattggtagtatcgatcacagtggagcacctactcgaacccgtcctcacgacctcgagtcgccagtactcacacgacaccgtaccaaagaacccagttacctaaccgtgaaggctagaaactcgtgtcgaccgccgcacgacacggccgtaatcttatgtgcgacggacttcggaggggtgatagtagtcggtctacgattcgtatccttcgttacgtacgtacgtgggccgaacgggtaaccctggtaccaccgttctaccccg

SEQ ID NO: 334938 - DNA, 522 bp, Homo sapiens
  misc_feature: GZ8MTXP02FT2U5.52.1.A01.1.454.CMB.2.raw
  modified_base (223)..(223): a, c, t, g, unknown or other
  misc_feature (223)..(223): n is a, c, g, or t
  modified_base (458)..(458): a, c, t, g, unknown or other
  misc_feature (458)..(458): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccagggactgggtgaagccttcggagatcatgtccctcacctgctctgtctctggtnactccatcagcagtgtatactggctggtcgcagccccagggagggttgagtggattgggagtatcgatcacagtgggagcacctacctcgaacccgtcctcacgacctcgacgtcgcatatcacagacacgtaccaacgaaccagttctacctgaggctagaactctgcgaccgcgcagacacggccgtatattatgtgcgcggacttcgagggggtgatagtagtggactacgnttacgtattctcgttacgacgtacgtcggggaccgaacgggtaccctggtacacccgtctcccg

SEQ ID NO: 334939 - DNA, 543 bp, Homo sapiens
  misc_feature: GZ8MTXP02F0NBT.52.1.A01.1.454.CMB.2.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgtatactggctggtcgcngccccgaggaggttgagtggatggagtatcgatcacagtggagcacctacctacgacccgtcctcgacgacctcgacgtcgccatactacacacgacaccgtaccaaacgaacccgtacgttacctaccgtgacggtctacgaactcgtgtcgaccgccgcacgacacggcctatattagttgtgcgcggacttcggaggggtgactagtagtggtcgtacgtagttcgtatcttcgttacgacgttacgcggggacccacggggtaaccctcggtccaccgttctacccg

SEQ ID NO: 334940 - DNA, 546 bp, Homo sapiens
  misc_feature: GZ8MTXP02H186E.52.1.A01.1.454.CMB.2.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
tcagcgcagtacgacacgaccggtgctcgatttagacgtctcatcaggggatgctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactccatcagcagtgttattacgtggccgtggtccgcacgccccgaggggtaggggtttgaggtggagttggggagtagtcgatcgacgaggtgggagacacccgtacctcgaaccccgtcctacccgacgactcgacgtcgaccatctacaaacacgaccaaccgtaccaaaacgaaccctagttcctaacccgtgaacggtctacgaactctgtacgacccgccgacagacacggcgtatattagtgtgcgcggactcggagggtgatagtgngctagtnttcgatctctgaacgtcgcggccacggacctcggtactccg

SEQ ID NO: 334941 - DNA, 664 bp, Homo sapiens
  misc_feature: GZ8MTXP02IWVU2.52.1.A01.1.454.CMB.2.raw
  modified_base (220)..(220): a, c, t, g, unknown or other
  misc_feature (220)..(220): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttcggagatcatgtccctcacctgctctgtctctggtnactccatcagctagtgttattacgtgggcctggtccgcacgccccgagggaagggttgagtggagttgggagtatcgatnacgaggtggganccgacctacctcgtaaccccgtccctacgaccgaccgtcgagtccgacctatactacacgagaccaccgtaccaaacgtaaccagttacctaaccgtgacggtctacgaaccttgtacgtccgaacccgccgacaacgaccgaccgggtccttaagtactttaagttcgtcggtaccgggaccgggtacgttacgggtagggggtaggtaacgttaagtaggttacggtaccgttaagttaaacgtttccggttaacttccgtttaccgtttaacggtacccgttaacggtccgggggtacccgtaaacggggtaaacccccgttggtaccccgtacccgttccgtaccccg

SEQ ID NO: 334942 - DNA, 534 bp, Homo sapiens
  misc_feature: GZ8MTXP02IC35E.52.1.A01.1.454.CMB.2.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (444)..(444): a, c, t, g, unknown or other
  misc_feature (444)..(444): n is a, c, g, or t
  modified_base (504)..(504): a, c, t, g, unknown or other
  misc_feature (504)..(504): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtgactccatcagcagtggttattactgggcctggtccggcagcccccgagggaaggggtttgagtggattgggagtatcgatcacagtgggancgacctactgaaccccgtcctcacgcctcgacgtcgccatatcacagacacgtaccaaagaacccagttacaacctgaaggctagaaactcgtgtcgaaccgcccgcagactacggccgtaatatttattgngcgcgggacttcgaggggtgatagtagtcggctaggattcgtatcgttctcgacttacgnggggccagggaaccctggccaccgtctccc

SEQ ID NO: 334943 - DNA, 568 bp, Homo sapiens
  misc_feature: GZ8MTXP02IBUHW.52.1.A01.1.454.CMB.2.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (546)..(546): a, c, t, g, unknown or other
  misc_feature (546)..(546): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggcaagtcagngcaattagaacgttatttaaatggtaaccaaacaagaaaccgaaggaaacgcccctagaactcctagattacttatcggttactaactcctaactttgactggtaggttcggggtccctatacgtaaggttcccaggtggcaggtgatcgtgggacagacttcacttcacaccatcaactntctgcgaggctaggtagtagtttanactaaactttaccttgtacgttacaactaggtaactttacaaccgtttccctcgtaccgtttccggcccgtacgggacctacgtaggttgaattacaactaaaccgattcgaggtcncgacaactctcgtcttctaccc

SEQ ID NO: 334944 - DNA, 535 bp, Homo sapiens
  misc_feature: GZ8MTXP02G8FK6.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactccatcagcagtgtatactggctggtcgcagccccagggacggtttgagtggattgggagtagtcgatcacagtgggagctacctactcgaacccgtcctacacgacctcgagtcgccatatcacagacacgtaccaaagaaccagttacctaccgtgacggtctagaaactcgtgtcgaccgccgacgacgacgacggtccgtatactttagtgtgcgacggactttcggaggggtgagttactgtggctacggtattcgtatactccttagacttagcgggtacacgggacctgtacgtaccgtctcccg

SEQ ID NO: 334945 - DNA, 573 bp, Homo sapiens
  misc_feature: GZ8MTXP02GQJX3.52.1.A01.1.454.CMB.2.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
  modified_base (433)..(433): a, c, t, g, unknown or other
  misc_feature (433)..(433): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagagtcatcatcacttgccgggnaagtcagancattagaacgttattaaatgtaccaanagaaaccaggaacncccctagaactcctanatctatggttcatcctatttgctgaggtcgggtcccagtctaaggttccagtggacaggttggacttcgtggggacaagtaactcactctacaccctntccgaccctagtcctgacgtaggctaggtaggttatttgaccttaaattccttntacgtacaactaggtacttacgctttcccactacgtttccggcccgttaggaccctaaagtcggtacgtaaatacgtaacgtaaaccgtaacgtggtcggaacttacggaccaacgtcttaccggttcgttacctttccg

SEQ ID NO: 334946 - DNA, 647 bp, Homo sapiens
  misc_feature: GZ8MTXP02FXBGV.52.1.A01.1.454.CMB.2.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (364)..(364): a, c, t, g, unknown or other
  misc_feature (364)..(364): n is a, c, g, or t
tcagcgcagtacgacacgaccggtgctcgatttagacgtctcatcaggggatgctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactcatcagcagtgttatacgtggcctggtccgcacgcccccgagggtacgggttgaggtggagttgggagtagtcgatcacgaggtgggacgcgaccctaccgtcgaaccccgtcctaccaccgactcgacgtcgccatntcaaacacgaccacgtaccaaagaacctagttctaccgtgagctagaactcgtacgtcgaccgccgcaacggaccgtaaccggtaccgttaattacgtttagttggtccggacggtcggggtaactttcgggagggggttagaagttacggtaacggtggtaccgttaacgggtactttaccggttaacttcccgttacccgtttacggaaccgttacggtaccgggggtacccggtaaaccgggggtaaacccccgttcggggtaacccctttaacccccgg

SEQ ID NO: 334947 - DNA, 641 bp, Homo sapiens
  misc_feature: GZ8MTXP02HJIML.52.1.A01.1.454.CMB.2.raw
  modified_base (222)..(222): a, c, t, g, unknown or other
  misc_feature (222)..(222): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttcggagatcatgtccctcacctgctctgtctctggtnactcatcagcagtgttattacgtggcctgggtccgcacgccccgagggaggggttgagtggagttgggagtatcgatcacgagtgggagcacctacctcgaacccgtccctcacgaccctcgacgtcgccatactcacagacaccgtaccaaacgaacctagttacctaccctggacgtctagtaacctcgtagtacgacccgccgacgaacgaccgaccgggtacccggttaatacttttagttcggtcgggccgggtaccggggtaccgttacggaggggggttaggagttaggtaggtcgggtaccgttaacggtagtttcggtacttccgttcccttacggtaaccgttaccggtcgggggtaccgtaaccggggtaacccgttccggggtaccctacccggttcccgttccccg

SEQ ID NO: 334948 - DNA, 532 bp, Homo sapiens
  misc_feature: GZ8MTXP02I6FUF.52.1.A01.1.454.CMB.2.raw
  modified_base (221)..(221): a, c, t, g, unknown or other
  misc_feature (221)..(221): n is a, c, g, or t
  modified_base (503)..(503): a, c, t, g, unknown or other
  misc_feature (503)..(503): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagcagtgttattactgggcctgggtccgcagcccccgagggaaggggtttgagtggattgggagtatcgatcacagtgggagcacctacctcgaaccccgtccctcaccgacctcgagtcgccatactcacagaccacgtaccaagaaaccagttcctacctgaggctagaactctgtcgaccgccgcagacacggccgtatattattgtgcgcgggtactcgagggggtggatagtagtggactacgtattcgtaattcctcttacgcttacgngggccacgggacctggtcaccgtctcccg

SEQ ID NO: 334949 - DNA, 597 bp, Homo sapiens
  misc_feature: GZ8MTXP02HVF96.52.1.A01.1.454.CMB.2.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (462)..(462): a, c, t, g, unknown or other
  misc_feature (462)..(462): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccgggnaagtcagagctattagaacgttatttaaatggtaaccaacaagaaaccgagggaaacncccctagaacctcctagactcttaatcggttacactcctacgttttgacgttggacggttcggggtaccctagtacgtaaggttccaggtcggctaaggtggacttcgaggggacagtaacttccactctaccaccatccacctagtctgcgaggtctaggtagttatttacgacttaactttcttntacgtacaacgtagtacgttacacgttccctacgtaccgtttcggacccgtagggtacctagttacgtaggaacttacgtaacaaacgtacgtggtacgtaactcgacctactattccgttacgtttcctttacc

SEQ ID NO: 334950 - DNA, 549 bp, Homo sapiens
  misc_feature: GZ8MTXP02G49VI.52.1.A01.1.454.CMB.2.raw
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtaaccaacaagaaaccgaagggaaacgacccctagaacctcctgatctatggttcatcctacttgctgtaggtcgggtccagtctaaggtccagtgcgagtgatcgtggacagaatcactctacaccatcacctntcgngagngctgtagttattacgacttaacttcttacgtcgtacaacgtagtacgttactacgttcctacgttccgttccggaccgtacggaactagtacggtacgtactaactaacgtaaacgtacgtcgtacgtctacgtactaccgtacttcgttacttacctttc

SEQ ID NO: 334951 - DNA, 590 bp, Homo sapiens
  misc_feature: GZ8MTXP02GO21U.52.1.A01.1.454.CMB.2.raw
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagcgcagtacgacacgaccggtgctcgatttagacgtctcatcaggggatgctttctgagagtcatggacctcctgtgcaagaacatgaagcacctgtggtttttcctcctgctggtggcagctcccagatgggtcctgtcccacgtgcagctgcaggagtcgggcccaggactggtgaagccttacggagatcatgtccctcacctgctctgtctctggtnctccatnagcagtgttattacgtggccgtgggtccgcacgccccgagggtagggttgagtggattgggagtancgatcacgaggtgggngcacctacctcgaaccccgtcctccgaccgactcgacgtcgaccatcacaaacagaccacgtaccaaacgacctagtacctacctagaggtctacgtaactcgttcgcgaccgaccgacgacgacgccgtaccgtatagtttagtgttcgcggacggtccttggaggggtagtagtaagtagggtcgattacggtaacttcggttactccgttccgtttgaaccgtttaacggtcggggacccgaaccggggttacctacggggttaccccttcccg

SEQ ID NO: 334952 - DNA, 643 bp, Homo sapiens
  misc_feature: GZ8MTXP02JWDP6.52.1.A01.1.454.CMB.2.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggcaagtcagagctaattagaacgttatttaaatggtaccaaacagaaaccagggaaacncccctagaactcctgatctatcgtcatccatttcgctgtagtcggggtacctatcgtaagttccgagtggctaggtgagttcgtggggaactagtaacttcaaccgttcaccacctataccgacctacgtctacgaccgagggtctaggtaaggttatttacgacttaaacgtttaccttcgtacgtaacaacgtacggttaacttaccgtaccgtttacccctaccgttaccgtttcccgggtacccgtacgggtaaccctagttaaccggtaggttaacctaacgtaaccgtaaaaacccgtcgttaacggttccggaacggttaccgacctaacccgtagtttccccgttagttaccccttttacccg

SEQ ID NO: 334953 - DNA, 612 bp, Homo sapiens
  misc_feature: GZ8MTXP02HBUFW.52.1.A01.1.454.CMB.2.raw
  modified_base (222)..(222): a, c, t, g, unknown or other
  misc_feature (222)..(222): n is a, c, g, or t
  modified_base (352)..(352): a, c, t, g, unknown or other
  misc_feature (352)..(352): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttggagatcatcgtccctcacctgctctgtctctggtnactccatcagcagtgttatactggcctggtccgcacgccccgagggagggtttgagtggattgggagtatcgatcacaggtggagcacctaccacgaaccccgtcctcacgaccctcgactcgccatacncacagacacgtaccaagaaccagttacctacctgacggctagaacttcgtgtcgacccgccgacgacgacaccgggtaccgtattaacgtttagttgtggccggcgggtaacgttcggaagggggtgaagttagtaggtacggtacgtaaccgtagtttccggtaacttccgtttaccgttacgaaccgttaccgggttcgggggaaccccgtaaacgggggtaaccccttggggtacccctaacccggttcctccccgg

SEQ ID NO: 334954 - DNA, 558 bp, Homo sapiens
  misc_feature: GZ8MTXP02I0WSZ.52.1.A01.1.454.CMB.2.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcatagaacgtattaaatgtacaacagaaacaggaaagcccctgaactcctgatctatggttcatccacttgctgagtggggtccatcaagttccagtggcagtgatctgggacagattcactctcacatcaccagtctgcaggctgaggtatttcgctaaactttacttctagtacaaaccgtagaacgtttaccacgtttccccttctaaccgttttccggaccccgttacggggaaccctaacgttagtacggtaattaaactaccgtaaaacgtaaacctggtagggtaaccgttcggaacaaccccgtattccttacggttacctttaccc

SEQ ID NO: 334955 - DNA, 555 bp, Homo sapiens
  misc_feature: GZ8MTXP02GQ24R.52.1.A01.1.454.CMB.2.raw
  modified_base (223)..(223): a, c, t, g, unknown or other
  misc_feature (223)..(223): n is a, c, g, or t
  modified_base (483)..(483): a, c, t, g, unknown or other
  misc_feature (483)..(483): n is a, c, g, or t
  modified_base (543)..(543): a, c, t, g, unknown or other
  misc_feature (543)..(543): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttcggagatcatcgtccctcacctgctctgtctctggtnactccatcagcagtgttattactgggcctggtccgcacgcccccgagggaagggtttgagtggagtttgggagtagtcgatcacaggtgggagcacctaccgtcgaacccgtcctcacgacctcgagtcgccatactacacagacaccgtacaagacagttcacctgacgctagaactcgtagtcgaccgccgcacgcgacggccgtatacgttatggtgcgacggacgttgaggggtgagtagtaggtggtcgtacgtnttcggttactccttacgttacgacgttacgtcgggggtccaacgggtaccctggtacccncggttcttcccg

SEQ ID NO: 334956 - DNA, 542 bp, Homo sapiens
  misc_feature: GZ8MTXP02H64PR.52.1.A01.1.454.CMB.2.raw
  modified_base (223)..(223): a, c, t, g, unknown or other
  misc_feature (223)..(223): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctccagatgggtcctgtcccacgtgcagctgcaggagtcgggcccaaggactggtgaagccttcggagatcatcgtccctcacctgctctgtctctggtnactccatcagcagtgttatactggctggtccgcagccccgagggagggttgagtggagttgggagtatcgatcacgagtgggagcgacctacgtcgaaacccgtcctcacgacctcgacgtcgaccatatacacagtacacgtaccaaagaanacccccgttnaccctgacggctagaactctgtacgaccgccgacacgacgacggtaccgtattattaattgtgcggnggtaccgtggaggggngtatagtagtggctagtatcgtatctctacgtacgtacgtgggccacgggtaacccgtggtaccacgtctccc

SEQ ID NO: 334957 - DNA, 510 bp, Homo sapiens
  misc_feature: GZ8MTXP02HKJWX.52.1.A01.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (472)..(472): a, c, t, g, unknown or other
  misc_feature (472)..(472): n is a, c, g, or t
  modified_base (503)..(503): a, c, t, g, unknown or other
  misc_feature (503)..(503): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggnaagtcagagcattagaacgtattaatgtacaacagaacaggaacncccctagaactcctgatctatggtcatcctattgctgagtcgggtccatcaagttccagtgcagtgatcgtgggacagaattcactcncaccatccacctagtcngcaggctggaaggttatttgacttaaactttntttcngttacaacagtagttaaccacgttccctacgtacgtttccggccgtacgggaacctagtacgtggattanacgaaacgactgtagcctgaccacattcgtnttacttc

SEQ ID NO: 334958 - DNA, 484 bp, Homo sapiens
  misc_feature: GZ8MTXP02IDO4R.52.1.A01.1.454.CMB.2.raw
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (221)..(222): a, c, t, g, unknown or other
  misc_feature (221)..(222): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (254)..(256): a, c, t, g, unknown or other
  misc_feature (254)..(256): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (269)..(271): a, c, t, g, unknown or other
  misc_feature (269)..(271): n is a, c, g, or t
  modified_base (273)..(273): a, c, t, g, unknown or other
  misc_feature (273)..(273): n is a, c, g, or t
  modified_base (276)..(277): a, c, t, g, unknown or other
  misc_feature (276)..(277): n is a, c, g, or t
  modified_base (282)..(283): a, c, t, g, unknown or other
  misc_feature (282)..(283): n is a, c, g, or t
  modified_base (285)..(286): a, c, t, g, unknown or other
  misc_feature (285)..(286): n is a, c, g, or t
  modified_base (288)..(288): a, c, t, g, unknown or other
  misc_feature (288)..(288): n is a, c, g, or t
  modified_base (290)..(291): a, c, t, g, unknown or other
  misc_feature (290)..(291): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagatcatcatcacttgccgganagnanannatanatatatanacananaacagancanancnnntntntnanctatnnngngcnnagtcnngnngngnngngananatatactcncacanacacatctgngagngtagtagtagttagtactaacttacttactagtactaactagtagttacgtacgttaccttactacgttccgtaccgtacgtacgtacgtagtagtaactaaactaacgtaaacgtaacgtagtacgtcgtacgtactactactacttacgttactac

SEQ ID NO: 334959 - DNA, 566 bp, Homo sapiens
  misc_feature: GZ8MTXP02F11QZ.52.1.A01.1.454.CMB.2.raw
  modified_base (222)..(222): a, c, t, g, unknown or other
  misc_feature (222)..(222): n is a, c, g, or t
tcagcgcagtacgacacgaccggtgctcgatttagacgtctcatcagggggctttctgagagtcatggacctcctgtgcaagaacatgaagcacctgttggtttttcctcctgctggtggcagctcccagatgggtcctgtcccacgtgcagctgcaggagtcgggcccaggactggtgaagccttggagatcatcgtccctcacctgctctgtctctggtnactcatcagcagtgtattactggctggtcgcacgccccgaggagggttgagtggagttgggagtatcgatcacaggtgggagcacctaccgtcgaaaccccgtcctcgacgacctcgacgtcgaccatactacacagacacgtaccaaagaacctagtcctaccgtagacggtactacgtaactcgttagcgaccgccgacgacgacgaccggtaccgtattattagtgtggcgacgggtctacgaggggtgatagtaggtcgactacgtattcgtaattcgtccgttacgactttaacggcgggccggaacggtaacccgtggtaccacccggttcttccccg

SEQ ID NO: 334960 - DNA, 594 bp, Homo sapiens
  misc_feature: GZ8MTXP02I0FJC.52.1.A01.1.454.CMB.2.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctcctgtccgcatctgtagganacagagtcatcatcacgttgccgggnaagtcagagctaattaagaacgttattaaattggtaaccaanagaaaccgaggaaacncccctagaactcctagatctatcggtacatctacttgctgaggtcgggtccatcgaggttccagtgacagtgatcgtgggacagtaactcactctcaccataccgactcgtctgacgaggtctaggaaggttatttacgacttaaactttcttcgacgtttaccaaacgtagtaacgttaccgtaccgtttcctacgttaccgttccgggacccgttacgggaaacccttacggttagtacggtaaacttaactaacggtaaaaccgtacgtttggaacggtcttacgacctaccgtacgtttctcggttaacctttaccg

SEQ ID NO: 334961 - DNA, 593 bp, Homo sapiens
  misc_feature: GZ8MTXP02HMXVC.52.1.A01.1.454.CMB.2.raw
  modified_base (180)..(180): a, c, t, g, unknown or other
  misc_feature (180)..(180): n is a, c, g, or t
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (342)..(342): a, c, t, g, unknown or other
  misc_feature (342)..(342): n is a, c, g, or t
  modified_base (577)..(577): a, c, t, g, unknown or other
  misc_feature (577)..(577): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgnatctgtagganacagagtcatcatcacttgccggnaagtcagagcattagaacgtatttaatggtaaccaanagaaaccgaggaacncccctagactcctgatctatgttacatcctattgctgaggtcgggaccatacgtagtccagtgctagtggatcgngggactagattccgactctaccacctataccaccgagtctgcgagtctaggtaagttctttacgaccttaaactttccgtttactacggttacccaaagtacgggttaacgtttaaccctacggtttaccccctacgttaaccccggtttccggacccccgtaggggtaaccctaggttacggtaggtaactaacgtaaccgaaaacggtacttggtcggaactcgcctaacgtntccgttacttcttccg

SEQ ID NO: 334962 - DNA, 623 bp, Homo sapiens
  misc_feature: GZ8MTXP02HKA7G.52.1.A01.1.454.CMB.2.raw
  modified_base (222)..(222): a, c, t, g, unknown or other
  misc_feature (222)..(222): n is a, c, g, or t
  modified_base (315)..(315): a, c, t, g, unknown or other
  misc_feature (315)..(315): n is a, c, g, or t
  modified_base (419)..(419): a, c, t, g, unknown or other
  misc_feature (419)..(419): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggccaggactggtgaagccttcggagatcatcgtccctcacctgctctgtctcgtggtnactcatcagtcaggtgttatacgtgggcctggtccgcacgccccgagggtagggttgaggtggagttgggagtatcgatcacgaggtgggacncacctaccgtaccgtaaccccgtcctacgacgacccgtcgagtccgactatactacaacaacacgtacaacgaacctagtacctacgtgacgctcgaacttcgngtacgacccgccgacgacgacgacggactattactagtttgcggtcggacggtacgttgggacggggttagtagttacggtaggtcgtaaccgttaacggtactttaccggttcttacccttcggttacggtaccgtacgggtacgggggaaccgtaaccgggtaacccggtcggtacccgtacccggtccttacccgacccgg

SEQ ID NO: 334963 - DNA, 529 bp, Homo sapiens
  misc_feature: GZ8MTXP02HCDB6.52.1.A01.1.454.CMB.2.raw
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatccctcctgtccgcatctgtaggagacagagtcatcatcacgttgccggcagtcagagcattagaacgtattaaatggatcaaacagaaaccgaggaacncccctagacncctagatctatgtacatcctattgctgacgtcggtaccagtcgaagttcaggtgactaggtgatcgagggactaagtactcaactctacactatcgaaactgtactgacgagtntagtagtatttgacttaactttctcggtatacaacgtntacgttacacgttccctactcgtttaccgaccgtggacctaagttcggagtaactacgtaacaaacggtaagtcgtacggcttacacaccctattccg

SEQ ID NO: 334964 - DNA, 588 bp, Homo sapiens
  misc_feature: GZ8MTXP02IPL4U.52.1.A01.1.454.CMB.2.raw
  modified_base (216)..(216): a, c, t, g, unknown or other
  misc_feature (216)..(216): n is a, c, g, or t
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
tcagcgcagtacgacacgaccggtgctcgatttagacgtctcatcagggggagtcagtctcagtcaggacacagcatggacatgagggtcccccgctcagctcctggggctcctgctactctggctccgaggtgccagatgtgtcatccagatgacccagtctccatcctcctgtccgcatctgtaggagacagagtcatcatcacttgccggganaagtcagagactaattaagaacgttaatttaaatcggtaaccaaacaagaaaccgaagggaaacncccctagaacctcctgactctagtgtacactcctattgctgaggtcgggtccatacgtaaggtccagtgcaggtgatcgngggacagtactcactctacacatccactgtctgaccaggtctaggtaggttactttgacttaaactttcttctacgttacaaacctaggtaacttaccgtaccgtttacccttacgttaccgtttcccggacccgttacgggaacctaacgtaggtaggtaacttaaactaacgaaaacgtacgtggtacgtccgtgaccctactacttccgtacgtttccttaccg

SEQ ID NO: 334965 - DNA, 670 bp, Homo sapiens
  misc_feature: GZ8MTXP02JFLZA.52.1.A01.1.454.CMB.2.raw
  modified_base (223)..(223): a, c, t, g, unknown or other
  misc_feature (223)..(223): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctcgtggtnactcatcagctagttgttattacgtgggccgtggtccgcacgccccgagggaaggggttgaggtggtagttgggagtagtcgatcgaacgaggtgggacgtaccctacccgtaccgtaccggaaacccccgttcccctaccgaaccgacccctcgacgtccgcctaatactaccaacacgaacctaaccgtaccaaacgaacctacgttcctaacccgtggaacgtcgtagtaacttcgtacgtccggacccgccgacgaacgaccgtacgggtcctaattacgtttagttacgtcggccggtcgggtacttacgggtagggggtgtaagttagtaggtacggtcgttaaacgtagtttaccgtacttaccttccgttacgaccgttacggtccggggtaccggtaaccgggtaacccgttcggtaccctaacccggtcctaccccg

SEQ ID NO: 334966 - DNA, 538 bp, Homo sapiens
  misc_feature: GZ8MTXP02JII43.52.1.A01.1.454.CMB.2.raw
  modified_base (188)..(188): a, c, t, g, unknown or other
  misc_feature (188)..(188): n is a, c, g, or t
  modified_base (462)..(462): a, c, t, g, unknown or other
  misc_feature (462)..(462): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
tcagcgcagtacgacacgaccggtgctcgatttagacgtctcatcagggggctttctgagagtcatggacctcctgtgcaagaacatgaagcacctgtggttttcctcctgctggtggcagctcccagatgggtcctgtcccagtgcagctgcaggagtcgggcccaggactggtgaagccttcgganatcatcgtccctcacctgctctgtctcgtggtcactcatcagctagtggttattactgggcctgggtccgcgagccccgagggtaagggtttgagtggagttgggagtatcgatcgacgtaggtggacgaccacctacctcggtaaaccccgtccctacgacgtacccgtcgaacgtcgaccatactacacgacgacacgtaccaagactagtcacctgacgctgaactctgacgacgcgcagctacggcgtatatatgtgcgacgtgactggnggtagtagtagagtcgtatagtacttntacgttctcgtntaacgtcgtcggacgacggtaccgtcggacctctccg

SEQ ID NO: 334967 - DNA, 613 bp, Homo sapiens
  misc_feature: GZ8MTXP02IVWZ3.52.1.A01.1.454.CMB.2.raw
  modified_base (222)..(222): a, c, t, g, unknown or other
  misc_feature (222)..(222): n is a, c, g, or t
  modified_base (443)..(443): a, c, t, g, unknown or other
  misc_feature (443)..(443): n is a, c, g, or t
  modified_base (494)..(494): a, c, t, g, unknown or other
  misc_feature (494)..(494): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactcatcagcagtgttattactgggcctggtccgcacgccccgagggtaagggttgaggtggtagttgggagtagtcgatcacgtaggtgggacgacctacctacctccggtaaaccccgtccctacgaccgacccgttccgacgtccgacctattacacaacgacgacaccgtaccaacgaactacgttctactgacgctagaactctagcgaccgccgnacgaccgacggtaccgtattagttattcggtacgcgccgggtacgttaggnggggtagtagttaagtgtaggtacctaggttacttcggttaactccgttccttacgaccgtttaccggcggggtacccgtacgggtaacccttcggtaaccgtaccggttcccttcccg

SEQ ID NO: 334968 - DNA, 614 bp, Homo sapiens
  misc_feature: GZ8MTXP02JJGXW.52.1.A01.1.454.CMB.2.raw
  modified_base (219)..(219): a, c, t, g, unknown or other
  misc_feature (219)..(219): n is a, c, g, or t
  modified_base (303)..(303): a, c, t, g, unknown or other
  misc_feature (303)..(303): n is a, c, g, or t
  modified_base (476)..(476): a, c, t, g, unknown or other
  misc_feature (476)..(476): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggccaggactggtgaagccttcggagatcatcgtccctcactgctctgtctctggtnactcatcagcagtgttatacgtggcctggtcgcacgccccgaggaggttgagtgagttggagtagtcgatcacgaggtgggacnctacctaccgtacgaaaccccgtcctacacgtacccgtcgacgtcgacctatactacacaagacaaccgtaccaaacgaacctacgttacctaaccgtgaacggtctaggtaaacctcgttacgacgaacccgccgacacggaaccgacggtccgtaattaactttagttcgngtcggcgggtaccgtaggtaggggtagtagttacgtagtcggtacttaggtagttaccgtagttccttccgttacgtaccgttaacggtcgggaccgtaacgggtaacccgtcggttaccgtacccgttccttacccg

SEQ ID NO: 334969 - DNA, 641 bp, Homo sapiens
  misc_feature: GZ8MTXP02JKPOJ.52.1.A01.1.454.CMB.2.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (311)..(311): a, c, t, g, unknown or other
  misc_feature (311)..(311): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctntggnactcatcagctagtgttattacgtggccgtgggtccggcacggcccccgaggggtaacggggttgaggtggagttgggagtagtcgatcanaggtgggacgcacctacgtcgtaaccccgtcctacacgacccctcgacgtccgacctagtataccacgacgacaccgtaccaaacgaaccctagtttacctaaccgtaggtacggtctacggaacttcgtagtcggacccgacgaccacgaccgaaccggtccgttaagttacgtttaagttgttacgggacggtccgggtacgttacgggaagggggtagtagttagtagggtcggtacgttacggtagtttacgtacgttccttacgttacggaaccttacggtcgggaaccgacgggtacccgtggtaccctaccggtccttacccg

SEQ ID NO: 334970 - DNA, 453 bp, Homo sapiens
  misc_feature: GZ8MTXP02IC5FB.52.1.A01.1.454.CMB.2.raw
  modified_base (178)..(178): a, c, t, g, unknown or other
  misc_feature (178)..(178): n is a, c, g, or t
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(264): a, c, t, g, unknown or other
  misc_feature (263)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (279)..(280): a, c, t, g, unknown or other
  misc_feature (279)..(280): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (290)..(291): a, c, t, g, unknown or other
  misc_feature (290)..(291): n is a, c, g, or t
  modified_base (297)..(297): a, c, t, g, unknown or other
  misc_feature (297)..(297): n is a, c, g, or t
  modified_base (299)..(300): a, c, t, g, unknown or other
  misc_feature (299)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (330)..(332): a, c, t, g, unknown or other
  misc_feature (330)..(332): n is a, c, g, or t
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccncatctgtaggagacagagtcatcatcacttgccgggcaagcagngcattagagtattaaatgacaananaacaggaacncnancnntntntgtnatctntnntgngnggcannagtcangnngngntgngananatcatcncacancacntnnnagngtgagtattagtactaacttacttctntanaatagtatactacttacctctacgttccgtccgtacgacgtactagtagtatataacaaacgtaactagtgcgtcacacatctctctc

SEQ ID NO: 334971 - DNA, 615 bp, Homo sapiens
  misc_feature: GZ8MTXP02F99RP.52.1.A01.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
tcagcgcagtacgacacgaccggtgctcgatttagacgtctcatcagggggagacagtctcagtcaggacacagcatggacatgagggtccccgctcagctcctggggctcctgctactctggctccgaggtgccagatgtgtcatccagatgacccagtctccatccctccctgtccgcatctgtagganacagagtcatcatcacttggccggnaagtcagagcaattagaacgtatttaaatgtaaccaanagaaaccgaggaaacncccctagaacctccngatctatggtcatcctatttgctgaggtcgggtcccagtacgaaggttccagtggcagtggatcgtgggacagtaattcactctcaccactacaccgtagtctgacgtacggctaggaaggttatttgacttaaactttctcgttacgtacaaacgtagtaacgtttacctaacgtttcccctacgttaccgtttccgggacccgtacggggaaccctaaggttacggttaggaaactttaacgtaaaccgtaaaacgggtaacttcgggttaaccggaactttccggaacctaaacccgttcttaaccggtttcgtttacctttaaccg

SEQ ID NO: 334972 - DNA, 648 bp, Homo sapiens
  misc_feature: GZ8MTXP02G23ES.52.1.A01.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctggtagganacagagtcatcatcacttggccggnaagtcagagctaattagaaacgttatttaaattggtaaccaaacaagaaaaccgaagggaaacgcccctagaacctcctagatcttatggttcatcctatttgctggagttcggggtacccatcgaaggttccagtggcaggtggattcgnggggacagtacttcactcncaccatcaccagtctgccgaggtctggtaggttatttgactaactttacttcgtacgttaccaacgtaggtaaacgttaccgtaaccggtttcccctacgttaacccgttttccgggtaccccgttaggggtaacccttaagttacggttacgggtaacttaaacgtaaccgtaaaaaccgggttaacgttcgggttacggtaaccgtttacgggaccctaaacccgtaagtttcccttaacggttttcccttttaacccg

SEQ ID NO: 334973 - DNA, 602 bp, Homo sapiens
  misc_feature: GZ8MTXP02GU43J.52.1.A01.1.454.CMB.2.raw
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactgggtgaagccttcggagatcatcgtccctcacctgctctgtctctggtgactccatcagcagtggttatactgggcctgggtccggcagccccccgaggggaacggggtttgaggtggattggggagtatcgatcacagtgggagcacctacctcgaaccccgtcctcacgaccctcgagtcgccatactcacagacacgtaccaagaaccagttcctaacctgacggctacgaactctggtacgacccgccggacacgaccaccgggtaccgtaattacgtttagttgttcggcggtcgggtacttcggagggggtaggattagtagtggacttacggtatttcggtaattccgttaccgttacgtaccttacggtcggggtcccgaacggggtaaccctcggggtccctaaccggtcccttacccg

SEQ ID NO: 334974 - DNA, 516 bp, Homo sapiens
  misc_feature: GZ8MTXP02FIJOJ.52.1.A01.1.454.CMB.2.raw
  modified_base (269)..(269): a, c, t, g, unknown or other
  misc_feature (269)..(269): n is a, c, g, or t
  modified_base (511)..(511): a, c, t, g, unknown or other
  misc_feature (511)..(511): n is a, c, g, or t
tcagcgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtattaaatgtatcaacagaaaccagggaaacncccctagaactcctgatctatggttcatccatttgctgagtcggggtccatcaaggtcagtggcagtgatcgtggacagatcactctcaccatacacagtctgcaggctagaggtatttgacttacttacttctagtacaatagtagttactcgttccctcgttacgtttcccggccgtagggacctaagttcggtacggtattaactacgaaaacgtaacgtggtacggctgacctaaccnttccg

SEQ ID NO: 334975 - DNA, 658 bp, Homo sapiens
  misc_feature: GZ8MTXP02FVPY3.52.1.A01.1.454.CMB.2.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctnacctgcttctgtctctggtnactccatcagctagtgtattacgnggctggtcgcacgccccgagggtaaggttgagtggagtgggagtagtcgatcacgaggtggagcctacctaccgtacgtaacccgtcctacgacgacccctcgacgtcgacctatactacacgacacaccgtaccaaagaacctacgttactaccgtagacgtactacggtaacttcgttacggaccgacccgaccgacgaaacgaccgaaccggtacccgttaattaccgttaagttcgttaacgggccggtacggtaccgttacgggtaggggttaggtaacgtagtaagggttcgggtacttaacggtaggtttaacgttacgttcctttacgttacgtaccgtttaaacgggtccgggaccgtaaaccgggtacccgtaggtaccccgtaaccggtcctttccccgg

SEQ ID NO: 334976 - DNA, 523 bp, Homo sapiens
  misc_feature: GZ8MTXP02HDGMN.52.1.A01.1.454.CMB.2.raw
  modified_base (401)..(401): a, c, t, g, unknown or other
  misc_feature (401)..(401): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctcgtccgcatctgtaggagacagagtcatcatcacttgccgggcaagtcagagcattagaacgtattaatgtaccaacagaaccaggaaacgcccctgaactcctgatctatggttcatcctacttgctgaggtcgggtccatcgtaagtccagtgcagtggatcgtggggacagtaacttcactctcaacccatcaaccagtctggcaggtcttgaaggttatttacntaaaacctttcttctgttacaaactagtagttacacgttccctactacgttccggcctcgggacctatacggtgataactacgaaaacgtacgtgtgaactcgactacatctacgtcttacc

SEQ ID NO: 334977 - DNA, 547 bp, Homo sapiens
  misc_feature: GZ8MTXP02FIZNY.52.1.A01.1.454.CMB.2.raw
  modified_base (95)..(95): a, c, t, g, unknown or other
  misc_feature (95)..(95): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (371)..(371): a, c, t, g, unknown or other
  misc_feature (371)..(371): n is a, c, g, or t
  modified_base (491)..(491): a, c, t, g, unknown or other
  misc_feature (491)..(491): n is a, c, g, or t
tcagcgcagtacgacacgaccggtgctcgatttagacgtctcatcaggggggagtcagtctcagtcaggacacagcatggacatgagggtccccnctcagctcctggggctcctgctactctggctccgaggtgccagatgtgtcatccagatgacccagtcctccatccctccctgcccgcatctgtagganacagatcatcatcacttggccggnaagtcagancattagacgttattaaattggtacaanagaaacaaggaaacncccctagaactcngatctatgtcatcctactttgctgaggttcgggtcccagtctaaggttccacggtgcagtggatcgtggacagtaattcactctcactancacatctgcgagctagtaggtatttacgacttaaacttactactgtaccaaactacggtagttaaccctacgtttccctactaccgtttcccggaccgttacggggaacctaggttacgnggtaactacgtaactaacgaacgtgtacggaactcgactaccattctctctttaac

SEQ ID NO: 334978 - DNA, 494 bp, Homo sapiens
  misc_feature: GZ8MTXP02IB8TB.52.1.A01.1.454.CMB.2.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccagtgcagctgcaggagtcgggcccaggactggtgaagccttggagatcatgtccctnacctgctctgtctctggtnactcatcagcagtgtatactggctggcgnagcccaggaggttgagtggatggagtatcgancagagtggancacctactcgaccctccncacacctcgagtcgacatacacacanacacgacaacaacatctacngagcnactctgcgacgcgcacgacacgacgtatattagttgtgcgcggacgtagtagggtaggagtagtagtagtacgtacgtatacgtactctctcgtacgtacgtcggacgaacggaccgtacgtacgtacgtctcg

SEQ ID NO: 334979 - DNA, 577 bp, Homo sapiens
  misc_feature: GZ8MTXP02HSC7W.52.1.A01.1.454.CMB.2.raw
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
tcagcgcagtacgacacgaccggtgctcgatttagacgtctcatcagggggagtcagtctcagtcaggacacagcatggacatgagggtcccccgctcagctcctggggctcctgctactctggctccgaggtgccagatgtgtcatccagatgacccagtctcccatccctccctgtccgcatctgtaggagacagagtcatcatcacttgccgggnaagtcagagctaattagaactaatttaaatggtaaccaaacgaaacagggaaacnccctagactccngatctatgtcatcctatttgctgaggtcgggtcccagtcgaaggttcagtggcaggtgatcgtgggacagtaattcaacctctacactactcaacctagtcctggaccaggtctaggtaggttatttcacttaactttactttcgtgtactaaacgtagtaacgttacctaaccgtttccctactaccgtttccggaccccgttagggaaccctagtacgtaggtaactacgtaaaccgaaaagtcgtaggtcgactaacgtcctaaactcttcgttcttcctttacttccc

SEQ ID NO: 334980 - DNA, 527 bp, Homo sapiens
  misc_feature: GZ8MTXP02FJK4W.52.1.A01.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (499)..(499): a, c, t, g, unknown or other
  misc_feature (499)..(499): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccggnaagtcagancattagaacgtatttaaatggtaccaacgaaacagggaacncccctagaactccngatctatggtcatccatttgctgagtcggggtcccatcaaaggttcagtgcagtggatcgtagggacagaattcactctacaccatccactacgtctgcaggctggaagttattttcgacctaactttaccttcgtgttacaacgtagtacgttactacgttccctctaccgtttccggccctacgggacctagtacggtgatacgtacaaacgtactggngtctgacaactcgtctcgtactcttacc

SEQ ID NO: 334981 - DNA, 684 bp, Homo sapiens
  misc_feature: GZ8MTXP02HMOXD.52.1.A01.1.454.CMB.2.raw
  modified_base (223)..(223): a, c, t, g, unknown or other
  misc_feature (223)..(223): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtcccctcacctgctctgtctctggtnactccatcagctaggtgttattacgtgggcctgggtccgcacgcccccgagggaaggggttgagtggagttgggagtatcgatcacgaggtgggagctacctaccgtcgaaaccccgtccctacgacgaccctacgacgtcgaccatactacacacgtaacaccgtaccaaacgtaaccctaacgtttacctaacccgttaggacggtactacgaaaccttccgtaggttccgacccggacccgaccgaacggaaccgaccgggtacccggtttaattaagtttttaacgttcggtacggtccggggtacgggtacgtttaccgggagggggttagtagtaaggttaaggtcgggtaccgttaacggtacgtttacggtaacttcctttaccgttacgtaccgttaacggtcgggggtacccgacggggtacccgtacgggtccacccggtttctcccccg

SEQ ID NO: 334982 - DNA, 571 bp, Homo sapiens
  misc_feature: GZ8MTXP02FKD28.52.1.A01.1.454.CMB.2.raw
  modified_base (265)..(265): a, c, t, g, unknown or other
  misc_feature (265)..(265): n is a, c, g, or t
  modified_base (361)..(361): a, c, t, g, unknown or other
  misc_feature (361)..(361): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagatcatcatcacttggccgggacaagtcagagcattagaacgttattaaatggtacaacagaaacaggaacnccctagaactctagatctatggtcatcctattgctgaggtcgggtccatcgtaggtccagtgcagtggatgtgggatagtaattcactctacacancaccagtctgacaggctagtacggttatttacgacttaaactttacttccgtagtactaaactaaggtacttaccgtacgtttacccctacgttaccgtttcccgggtacccgtacggggaccctaagtttacgggtagtaactaaactaaccgtaaaacggtaacgtgggtacggtctacgacctacctatccttacgttcttaacccg

SEQ ID NO: 334983 - DNA, 601 bp, Homo sapiens
  misc_feature: GZ8MTXP02FJXRI.52.1.A01.1.454.CMB.2.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (387)..(387): a, c, t, g, unknown or other
  misc_feature (387)..(387): n is a, c, g, or t
tcagcgcagtacgacacgaccggtgctcgatttagacgtctcatcaggggatgctttctgagagtcatggacctcctgtgcaagaacatgaagcacctgtggttttttcctcctgctggtggcagctcccagatgggtcctgtcccacgtgcagctgcaggagtcgggcccaggactggtgaagccttcggagatcatgtccctcacctgctctgtctntggtnactccatcagcagtggttattacgtgggccgtgggtccggcgacgcccccgaggggtaggggtttgaggtggtagttggggagtagtcgtatcgacgaggtgggacgccgtaccctaccgtcgaacccccgtcctaccgaccgtactcgacgtccgccaatcnccaaacacgaccacgtaccaaagaaccctagttcctaccctgagctagaactcgtgtcgaccgccgacacgacacggactatacttagtcgcgcggtcggtacgttcggaggggtgtagtagtaggtcggtcttaacgtattacgtacttaccgtcgtttagaacgttaccggttcgggggaccgtacgggtaaccctcggtacccgttacccg

SEQ ID NO: 334984 - DNA, 665 bp, Homo sapiens
  misc_feature: GZ8MTXP02HJJQE.52.1.A01.1.454.CMB.2.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttgganatcatcgtccctnacctgctctgtctctggtgactccatcagcactgttatacgtggccgtggtccgcacgccccgagggagggtttgaggtgagtgggatagtcgatcganaggtggagccacctacctaccgaacccctccctacacgacccgtcgacgtccgaccatacacacacgacaccgtaaccaacgaaaccgacttaccgtaaaccgtggaacggtcttacggaaaccttcgtgaccgacccgcccgacgaacgacccgtaacggggacccgttattaaggttttacgttggtacgccggggtaccgggttaaacccgtttcgggaagggggttggtaaatttaacggtggtacgggtaccttaaaccgggtttatttaccgttacttccgttcgttaccggtaccgttacggtccggggtaccccgaacggggtcccgtacggtacccgtaccgtttcccgtacccg

SEQ ID NO: 334985 - DNA, 695 bp, Homo sapiens
  misc_feature: GZ8MTXP02JJ2R2.52.1.A01.1.454.CMB.2.raw
  modified_base (282)..(282): a, c, t, g, unknown or other
  misc_feature (282)..(282): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtccgggcccaggactggtagaagccgttcggagatcatcgtccctcacctgctctgtctcgtggtcactccatcagcaggttgttatacgtggcgtggtcgcacgccccgagggtaggttgnggtggtagtgggatatcgatcgacgaggtggacgtaccgacccgtaccgaccggtaaacccccgtcccgtacgaccgtacccgtaccgacgtaccgacctactaccgtacaccgaacgaaccaacccgtaacccgaaacgtaacccgtaccgtttacctaaacccgtcgaacggtaccgtacgtaaaccttcgtacggtccgacccgccgaacgacgaaccgtaccgggtaccgttaattagttacgttggtcgggtaccggtaccgggtacgttacggggtaggggtacgaagttaggtaggtacggtacttaaacggttacttacggtacttaccgttaccgttacggtacgtaaacgggttccgggaaccggtaccgggtaaccgtcggtaccctaccggtccttacccg

SEQ ID NO: 334986 - DNA, 736 bp, Homo sapiens
  misc_feature: GZ8MTXP02I4VAI.52.1.A01.1.454.CMB.2.raw
  modified_base (321)..(321): a, c, t, g, unknown or other
  misc_feature (321)..(321): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccacgtgcagctgcaggagtcgggccaggactggtgaagccttggagatcatcgtccctcacctgctctgtctcgtggtcacctcatcagcgtaggttgttattacggtcgggtccgtcgggtccgacgccgacccggaggggtaggttgaggtggtagttgggatagtcgatacgagnggtaggacacccgtacctaccgtaccgtaaccccgtccctacgaccgtaccgtaccgacgtaccacctatacaccacgtaacgaacctaccgaaccgtaaacgaaccgttacgttaccctaccgtaggacgtaccgtaacgtaaccgttcgttacgggacccgacccggaccgacgaaaccgaccgaacccgggttacttaaagtttacgtttaagttccgggtacgggtacccgggtaccggggttaacgtttacgggggagggggtttaaactaagtttagggtaaagggcggttaaaccgttacggtttacgttaccggttaacttccggttaccgtttacgtaccggttaaccggtccgggggtaacccgtaacggttaacccgtcggtaacccggtcccttcgtaacccg

SEQ ID NO: 334987 - DNA, 670 bp, Homo sapiens
  misc_feature: GZ8MTXP02I6ITE.52.1.A01.1.454.CMB.2.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (357)..(357): a, c, t, g, unknown or other
  misc_feature (357)..(357): n is a, c, g, or t
tcagcgcagtacgacacgaccggtgctcgatttagacgtctcatcagggggctttctgagagtcatggacctcctgtgcaagaacatgaagcacctgtgttttcctcctgctggtggcagctcccagatgggtcctgtcccacgtgcagctgcaggagtcgggcccaggactggtgaagccttcggagatcatcgtccctcacctgctntgtctctggtnactcatcagctagtgttattacgtgggccgtggtccgcncgccccgaggggtaagggttgagtggagttgggagtatcgatcgacaggtgggagcccacctaccgtcgaaccccgtccctacgacgacctcgagtcncatactcacacgacaccgtaccaaagacctagttctaccgtgaggctacgaactcgtagtaccggaccgcccgacacgaccgacggggtacccgttattaaacgttttagttcggtcgggtccggtaccggggtaacgtttcgggagggggttagtagttaagtaggttcgggtacgttacgggttaaacgtttccgttaaacgttcctttacccgtttggtaaccgtttaaccgggggttcggggaccccggtaaaccggggttaacccccgttcgggttaaccccggtaccccggttaccgtttacccccg

SEQ ID NO: 334988 - DNA, 669 bp, Homo sapiens
  misc_feature: GZ8MTXP02IAD2E.52.1.A01.1.454.CMB.2.raw
  modified_base (217)..(217): a, c, t, g, unknown or other
  misc_feature (217)..(217): n is a, c, g, or t
  modified_base (507)..(507): a, c, t, g, unknown or other
  misc_feature (507)..(507): n is a, c, g, or t
tcagcgcagtacgacacgaccggtgctcgatttagacgtctcatcagggggatcagtctcagtcaggacacagcatggacatgagggtcccccgctcagctcctggggctcctgctactctggctccgaggtgccagatgtgtcatccagatgacccagtctcccatcctccctgtccgcatctgtaggagacagagtcatcatcacttggccgggnaagtcagagctaattaagaacgttatttaaatcggaacctaaacgaacgaaaaccgaaggaaacgcccctagaacctcccgtagacttacctaagttcggttacctacgttcccttaacgttttcgcgttacggtaacggtcggggtacccctaagtacgtaagggtttcccgaaggtcggacgtaagggtcggtacgtcggtaggggaactaagttaaacttacccactccctacaccgtactaccaaacccgtgtccgtgaccgtacggtcgtagtagttacgttttnaaccttaaacctttcttgtacgttaacaacgtagtagttacctacgttccctacgttacgttccggtaccgtacggtaccctagtacggtagtaaacgtaactaacgtaaaccgtacgttggtaacggcttacgacacttacgtcctttacgtttaccttcc

SEQ ID NO: 334989 - DNA, 769 bp, Homo sapiens
  misc_feature: GZ8MTXP02FV91Q.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatcgtccctcacctgctctgtctctggtnactccatcagcagttgttattacgtggcctggtccgcacgccccgagggagggttgagtggagttgggagtatcgatcgacgaggtgggacgccctaacccgtaccgtacggtaaaccccccgtccccgtaccgaccgtaccccgtaccgacgttccggaccctaattaccgttaccaaccgacgaaacctaaccggttaacccccgaaaagtaaaccccgtaacgggtttaccctaacccgtacggaacggtacgtacgtaaaccgttccgttaggtacccggaaccccggcccggaccgaaacggaaccgaacccggggtacccttaagttaacgtttaagtttcggtcgggtacgggtaccggggtaccgtttaccgggagggggttacgtaagttaacggttagggttaggtaaccgttacgggttaaactttccggttaaactttccgtttacccgtttacggaccgtttacgggtcgggggttacccgaacgggggttaaaccccgtcgggtaacccgtaccccggttcctttaacccccgg

SEQ ID NO: 334990 - DNA, 679 bp, Homo sapiens
  misc_feature: GZ8MTXP02H8BYC.52.1.A01.1.454.CMB.2.raw
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccacgtgcagctgcaggagtcgggcccaggactggtgaagccttcggagatcatcgtccctcacctgcttctgtctctggtgactccatcagcagttggttatacgtcgggcgtcgggtccggcgaccggacccccggtaggggtaacggggtttgaggtggtaggttggggagtagtcgatacgaacgaggtaggggacgacaacccgttaccgtaccgtaacccccgtcccctaccgacgaaccccgtcgacgtccacgtatactaccacacgaaccaccgtaaccaaacgtaacccacgtttcctacccgttaggacgtctacgtaacctcgttacgtcggacccgaccgacgacggaccgaaccggtccgttaagttaagtttacgttggtcggcggtacgggtacgttacggtagggggtagtagttagtaggtcggtacgtacgttagttacgttacttccgttaccgttacgtaccgtacggtcggggaccgaaccgggtaccgtcggtacccgtaccggttcctccccg

SEQ ID NO: 334991 - DNA, 557 bp, Homo sapiens
  misc_feature: GZ8MTXP02IYRH2.52.1.A01.1.454.CMB.2.raw
  modified_base (179)..(179): a, c, t, g, unknown or other
  misc_feature (179)..(179): n is a, c, g, or t
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgnatctgtagganacagagtcatcatcacttgccgggnaagtcagagctattagaacgtattaatgacaanagaacaggaacncccctagactccngatctatgtcatcctacttgctgacgtcgggtaccatcgaagttcagtgcagtgattcgnggggacagtaacttcactctccaacatacaccagtcngacaggctagaggtatttcactaaacgtttacttacacgttacaactaggtaacttacctacgttccctatcgtttaccgaccgtagggacctagtacggtaggtaacttaacttaaccgaaaagaaccgtttgacgggtaaccttacggaacctaccctaagtcccgttttacgttacctttaccg

SEQ ID NO: 334992 - DNA, 715 bp, Homo sapiens
  misc_feature: GZ8MTXP02HQ6OB.52.1.A01.1.454.CMB.2.raw
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccagtgcagctgcaggagtcgggcccaggactggtgaagccttggagatcatcgtccctcacctgctctgtctctggtnactccatcagcaggttgttattacgtgggccgtgggtccggcacggcccccgaggggtaaggggttgaggtggagtttggggagtatcgatcgacgaggtggggacgccgtaaccctaccgttacggaaacccccgtcccctaccgaccgtaccccgttacgacgttccgacccaatactacacacgaacaccgtaccaaagaaccctagttaccctaacccgtagaacggtctacgtaactccgttagacgacccggccgacgacggaaccgtaacccggggccttaaatttacgtttaagttggttcggaccggtacggggtaacctttcgggaagggggtagggtaattaccgtaaggtcggggtaccttaaaaccggttgttaccgtatttccggttccctttgggtaaaacccttacgggttcgggggaccccgttaacgggggtaacccccttggggtaacccctacccgggtaccctttacccccgg

SEQ ID NO: 334993 - DNA, 682 bp, Homo sapiens
  misc_feature: GZ8MTXP02HB2NY.52.1.A01.1.454.CMB.2.raw
  modified_base (289)..(289): a, c, t, g, unknown or other
  misc_feature (289)..(289): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatcgacccagtcctccactccctccctgtccgcatctggtaggagacgagggtcatccatctacgttggccgggacaagtcaagagactagttagaacgttaatttaaattcggaaccaacaagaaaccgagggaaacncccctagaacctctagatctagtcggtcactcctagtttgctggtacggtcggggtcccagtctaaacggttcgaaggtcggacgtagtgggtaatccggttagggacacgttaacttccacttacctaccacctacgttacccaaacccttacgttactcggtaaccggtcgggtacgtacgggttaacgtttaacgtttaccgtaaccgtttaacctttaccgttccgttaaccgtaaaccgtaaacgttaacgttaaccgtttacccgttacccgttcccgttaccgttacccggttccggtaccggtacggactagtacgtacgtaataacgaacgtaaacgtacgtcgtacgtctcgtacctactcgttcgttactaccttactaccg

SEQ ID NO: 334994 - DNA, 639 bp, Homo sapiens
  misc_feature: GZ8MTXP02ISDIM.52.1.A01.1.454.CMB.2.raw
  modified_base (217)..(217): a, c, t, g, unknown or other
  misc_feature (217)..(217): n is a, c, g, or t
  modified_base (372)..(372): a, c, t, g, unknown or other
  misc_feature (372)..(372): n is a, c, g, or t
  modified_base (615)..(615): a, c, t, g, unknown or other
  misc_feature (615)..(615): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccgggnaagtcagagactattaagaacgttatttaaatggtaaccaacaagaaaccaagggaaacgcccctagaactcctgatctatggttacactccactttgacttgtaggtcggggtaccctatacgtaagttccgagtcggcaggtagacgttacgnggggactaaggtaacttcgtactctaccaccacttccacctatcgtcgacgagtccgtggtacgttagtttcacttaaacctttactttactacgttaccgaacttaggtaccgtttaactaccggtttccccttacgttaccggtttcccggtaccgtacgggaccctaaagtccggttaaggtactaaacgtaaacgtaaaccgtaacgttcggtacggtaacgtacgtaccctaaacctntttaccctgtttacctttacccgg

SEQ ID NO: 334995 - DNA, 644 bp, Homo sapiens
  misc_feature: GZ8MTXP02I1OGH.52.1.A01.1.454.CMB.2.raw
tcagcgcagtacgacacgaccggtgctcgatttagacgtctcatcagggggctttctgagagtcatggacctcctgtgcaagaacatgaagcacctgttggtttttcctcctgctggtggcagctcccagatgggtcctgtcccacgtgcagctgcaggagtcgggcccaggactggtgaaggcttcggagatcatcgtccctcacctgctctgtctcgtggtcgactccatcagcagttggttattacgtgggccgtgggtccgcacgccccgaggggtagggttgaggtggagttgggatagtcgatcgacgaggtgggacgcctaccgtacccgtaccgtaaaccccgtcccctacgaccgtaccccgtaccgacgtccgaccatactacacacgacaccgtaccaacgacctagttaccacgtgacggctagactgtgtccgaccgccgacgacgcgtaccgggtaccttaattaagtttgttggtcggtacgggtccgggtacgtttacgggagggggtagtagttagtaggtcggtacgttacgttacgtttcgtacgtccgtttacgtacggtaccgttacgggttccggggaccgtaacgggtaccccgttcggtaccctacccggttcctccccg

SEQ ID NO: 334996 - DNA, 613 bp, Homo sapiens
  misc_feature: GZ8MTXP02FVF5Q.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactccatcagcagtgttattactgggcctgggtccgcagccccgagggagggtttgagtggagttgggagtatcgatcacaggtgggagcacctacctcgaaccccgtccctacacgacctcgagtcgccatactacacagacacgtaccaagaaccagttctacctgacgctagactctgtcgaccgccgacgagaccgacggaccgtaattactttaagtttcggtcggcggaccgggtaccgtttacggagggggttaggtattaaggtacggtggtaccgttaccgtaagtttccggtaacttccttacccgtttagtaccgttaacggtcgggggacccgaaccggggtaaaccccgttggggtaccccacccggttccttaccccg

SEQ ID NO: 334997 - DNA, 673 bp, Homo sapiens
  misc_feature: GZ8MTXP02JG941.52.1.A01.1.454.CMB.2.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttggagatcatcgtccctnacctgctctgtctntggtnactccatcagctagtgttatacgtggctggccgnacgcccgaggtacggttgagtggagttggagtatcggatcgaacgtaggtagggaacgcccgtaacccgttaccgtaccggaaaccccgttcccctacgtaaccgaccgttaccgacgtccgaccaattacacaacgacaaccgaacgtaccaaacgaaaccgtacgttaccctaaccgtgacggtacctagtaaacctcgttacgcgacccgccgacgacgaaccgaccggtacccgttaattaacctttaaggttcgtacgggtacccggacgggttacttacgggtagggggtagtagttacgaagtcggtactacggtatttccggtaacttccgttaccgttacgtaccggtacgtccggggactaaccggggtaaacccgtttcggggaacctacccgggtctttacccccg

SEQ ID NO: 334998 - DNA, 602 bp, Homo sapiens
  misc_feature: GZ8MTXP02GXF6Y.52.1.A01.1.454.CMB.2.raw
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
tcagcgcagtacgacacgaccggtgctcgatttagacgtctcatcagggggctttctgagagtcatggacctcctgtgcaagaacatgaagcacctgttggtttttcctcctgctggtggcagctccagatgggtcctgtcccagtgcagctgcaggagtcgggcccaggacctggtgaagccttggagatccatcgtccctcacctgctctgtctcgtggtnactcatcgagcagttgttatacgtggctggtccgcncgccccgagggtaggttgagtgtagttggagtatcgatcacgaggtggacgcaacctacctacgaacccgttccaccgtacgacccgtcgacgtcgacataactacacgacacacgtaccaagaaccagttacactagagtacagaactcgtataccgacgcgacgacgtaccgacggtccgtaattagttagtgtacggcggccgggtacttacgggagggtagtagtagtaaggtgtacgtacgtagttcggttaacgtctttaccgacgttaacggtacggttaacggggaccgtaaacgggggtacccttcggtaccgtttacccggcgtttaaccccg

SEQ ID NO: 334999 - DNA, 664 bp, Homo sapiens
  misc_feature: GZ8MTXP02I4F6C.52.1.A01.1.454.CMB.2.raw
  modified_base (224)..(224): a, c, t, g, unknown or other
  misc_feature (224)..(224): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttaaggagatcatcgtccctcacctgctctgtctcgtggtnactcatcagctagttgttatacgtggcgtggtccgcncgcccgagggtaggtgngtgagtggatgtcgancgacgaggtggacgcctaccgtaccgtaccgaaccccgtccctacgaccgtacccgtcgacgtaccaccgtatacgtaacacgacgaacctaacccggtaaccaaacgtaaacccgtacgttacctaacccgtggacggtctaacggtaaccttcgtacgtccgaaccgccgaacgacgaccgtacggtccgttaattagtttagtcgtcggaccggtacggtacgttacgggagggggttagaacgtttaggtaggtacggtacgttaacgttacgttcgtaacttccgttaccgttacgaaccggttacggtaaccggggaccgtaaccggggtaacccgttcggacccgttaccgttccgtaccccg

SEQ ID NO: 335000 - DNA, 627 bp, Homo sapiens
  misc_feature: GZ8MTXP02IUHTX.52.1.A01.1.454.CMB.2.raw
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagcctgcaggagtcgggcccaggactggtgaagccttcgggagatcatgtccctcacctgctctgtctctgtgactccatcagcagtgttatactgggctgggtccggcacgcccccgagggacggggtttgaggtggagttgggagtatcgatcacgagtgggagcacctacctacgaaccccgtccctcaccgtaccgtccgagtccgacctatactacacgtagaactaccgtaccaagaaccaggtttaccctaaccgtgacggtctacggaaaccttcgtacgtccggaaccggcccgacgaacggaccgaaccggggtacccgttattaacgtttagttcggttgggaccggcggggtacttacgggagggggtagtagtaagtaggtcgtacgtacgtatttcgtactcttaccttagtacctaggtcgggaccgaacgggtaacccgtggtacccgtaccgtccttcccg

SEQ ID NO: 335001 - DNA, 548 bp, Homo sapiens
  misc_feature: GZ8MTXP02HVNMX.52.1.A01.1.454.CMB.2.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (490)..(490): a, c, t, g, unknown or other
  misc_feature (490)..(490): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctnacctgctctgtctctggtnactccatcagctagtgttattactgggcctgggtccggcacggcccccgtagggaaggggtttgaggtggagttgggagtatcgatcanagtgggagcactacctgaaccccgtccctnacgacctcgagtcgcatancacngacacgtccaaagaccctattcctacctgacggctagaactcgtgcgaccgtcgcacgacaccggtccgtaattatttacgtgtcgcgtcgggacttcggaggggttgatagtaggtggctacggtnttcgtatctcctgacctacgtgggaccctagggtaccctggtacctaccggtctcccg

SEQ ID NO: 335002 - DNA, 616 bp, Homo sapiens
  misc_feature: GZ8MTXP02FQY0Y.52.1.A01.1.454.CMB.2.raw
  modified_base (219)..(219): a, c, t, g, unknown or other
  misc_feature (219)..(219): n is a, c, g, or t
  modified_base (347)..(347): a, c, t, g, unknown or other
  misc_feature (347)..(347): n is a, c, g, or t
tcagcgcagtacgacacgaccggtgctcgatttagacgtctcatcagggggctttctgagagtcatggacctcctgtgcaagaacatgaagcacctgtggtctttcctcctgctggtggcagctcccagatgggtcctgtcccacgtgcagctgcaggagtcgggcccaggactggtgaagccttggagatcatgtccctcacctgctctgtctctgtnactcatcagctagtgttattacgtggctgggtccgcacggcccccgagggtaacggggttgagtggtagttgggagtatcgatcgacgaggtggagcacctaccgtcgaacccgtcctcacccgtacncgagtcgcatactcaacagacacgtaccaacgaaccacgttacacctgacgctagaaccttcgagtcgaacccgccgacgacggaaaccgaccgggaccttaatacgtttaagttgggtcggaaccggtgggtaccttggtaagggggtgtaagtagttaggtcggtacgttacggtacgttacgttaacgttccttaccgttacgtacgtaacggttacgggacccggtaacggggtaaccccgttggtacccgtacccggtttcccg

SEQ ID NO: 335003 - DNA, 533 bp, Homo sapiens
  misc_feature: GZ8MTXP02FG61P.52.1.A01.1.454.CMB.2.raw
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtcctccatccctccctgtccgnatctgtaggagacagagtcatcatcacttgccggnaagtcagagcattagaacgtattaaattggtaccaacagaaaccagggaaancccctgaactcctgatctatggttcatccactttgctgagtggggtccatcaaggttccagtgcagtgatctgggacagaattcaccctnaccntcaccagtctgcaggctgaggtattttgactaacttacgtctagtcaacgagagttgctacgttccctcgtaccgttcggacccgttcggaaccgtacgtagtggtaatacttacaaaacgtaaacgtggttcgggcttcggaccacctaacgtccttcggttctttcccg

SEQ ID NO: 335004 - DNA, 989 bp, Homo sapiens
  misc_feature: GZ8MTXP02I8I5U.52.1.A01.1.454.CMB.2.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtcctccatcctccctgtccgcatcgtgtaggagacagagtcatcatcacgttcggaccgggacaagtcagagactaagttaacgtaaacgttaattttaaagttacggtaacccaaaacgaaacggaaaacccgaacggggaaaaccgtaccccccgtaacgtaaaccccgttacccgtacggtaactttaccgtttaacgtttcggtttacctaaccgtttaccccgtttaaccgtttttcggtacccggtttaggggttaacggggttttaccccgggggggttaaccccctaaacggtttaacccggttaaaacggggttttaccccggaaacggggtttaccggggaccgtaaacggggttttaggggtaaacggtttaccgggttacgggggggtaaacctaaaacgggttaaaaaccgttttaccccgttaaaacccgtttccccttaaaccctaaaccccggtaaaccgtttaaccctaaaacccccgttaaaggtttccccgttacgggaacccgggttaaaagggggtccctttaaaggggttaaacgggggtttttaaacctttttacggaaacccttttaaaacccggtttttaaaccctttttacggttacggttaaaaccctaaacgggttaacggttaaaacccgtttttaacccgtacccgtttttacccccgtaccggtttaacccgttttacccggggccccggttacggggtaacccttaagggttaccggtaagggtaacttaaacgtaaaccgtaaaacgtacgttggtacggcttcgactaccctagttcctacggtttactttacccg

SEQ ID NO: 335005 - DNA, 520 bp, Homo sapiens
  misc_feature: GZ8MTXP02FKMAT.52.1.A01.1.454.CMB.2.raw
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
tcagcgcagtacgacacgaccggtgctcgatttagacgtctcatcagggggctttctgagagtcatggacctcctgtgcaagaacatgaagcacctgtggttttcctcctgctggtggcagctcccagatgggtcctgtcccacgtgcagctgcaggagtcgggcccaggactggtgaagccttcggagatcatgtccctcaccctgctctgtctctggtgactccatcagcagtggttattactggcctgggtccgcagcccccgaggggaaggggtttgaggtggatttgggatatcgatcacagtgggagcacctacctgaaccccgtcctcaccgacctcgagtcgcatatcacagacacgtccaagacagttctaccctgaggctgaactntgtgaccgccgcagacacgccgtatnttattgtgcgcgggacttcgaggggttggatatagtggctacgatttcgtatctcctttggactacgtcgggcgacggaccctggtccaccgtctccc

SEQ ID NO: 335006 - DNA, 642 bp, Homo sapiens
  misc_feature: GZ8MTXP02GHJZ7.52.1.A01.1.454.CMB.2.raw
  modified_base (220)..(220): a, c, t, g, unknown or other
  misc_feature (220)..(220): n is a, c, g, or t
  modified_base (453)..(453): a, c, t, g, unknown or other
  misc_feature (453)..(453): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagccttggagatcatcgtccctcacctgctctgtctctggtnactcatcagcagtgttattacgtggctggtccgcacgccccgagggaaggggtttgagtggagtttgggagtatcgatcgacgaggtgggagccaccgtacctacgaaacccgtcctcaacgacctacgacgtcaccctaatactacaacagaactaccggtaccaaaacgaaaccacgtttactaaccctagacggtacttacggaaactcgtaggtacgacccgaccccgnaaacgaacgaaccgggtaccttaaattaactttaagttggtaggcggaaccggggtaccttagggtagggggtaggtagttaagtaggtaggtacctaacggtatttacggtaacttcgtttccgttaggaaccttaacggtcggggaaccacgggggtaaaccctggtacccaccggtcctttacccg

SEQ ID NO: 335007 - DNA, 693 bp, Homo sapiens
  misc_feature: GZ8MTXP02F46H1.52.1.A01.1.454.CMB.2.raw
  modified_base (303)..(303): a, c, t, g, unknown or other
  misc_feature (303)..(303): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtgactccatcagcaggttggttattacgtgggccgtgggtccgcacgccccgagggtaagggtttgaggtggagtttgggagtntcgatcactaggtggacgccaccctaccgtcgaaaccccgtccctacgaccgacccttcgacgtcgacctatatcaacgagaaccgaccgtaccaaacggtaaaccctagtttacccgtaccgtagacggtccgtagtaaaccttcgtaggtccgaccggaccgacgacgaccgaaccggtaccgtataactttagttcggtcgtcggaccgggtacgttaccggagggggttagggaattacggttaggtacggtacccgttaagttaggtttacccgttaagttcccgttaccgttacgtaacccggttaacggtaacccgggggtaacccaaccgggggttaaaccccggtaccgggttaccctaccccgggtttaccttcccccgg

SEQ ID NO: 335008 - DNA, 609 bp, Homo sapiens
  misc_feature: GZ8MTXP02FU6H7.52.1.A01.1.454.CMB.2.raw
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatcgtccctcacctgctctgtctctggtnactccatcagcagtgttattacgtggcctggtcggcacgccccgagggagggttgagtggagtgggagtntcgatcgacgaggtgggacgccacctaccgtcgaaccccgtccctaccaccgacctcgacgtcgccatatcacacgacaccgtaccaaacgaacctagttacctacgtgaggctagacttctggtaccgaccggccgcgaacgacgaccgggactacttagttagttgtcggacggaccggtacgttacgggtaggggtagtacgtagtaaggtcggtactaacggttatttacggtattccgttccgtttcgtaacgttacggtaacggggtccgaaccgggtaacccggtcggtaccgtcccggttcttaccccg

SEQ ID NO: 335009 - DNA, 617 bp, Homo sapiens
  misc_feature: GZ8MTXP02FGSZ6.52.1.A01.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (381)..(381): a, c, t, g, unknown or other
  misc_feature (381)..(381): n is a, c, g, or t
  modified_base (517)..(517): a, c, t, g, unknown or other
  misc_feature (517)..(517): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagcctttcggagatcatcgtccctcacctgctctgtctcgtaggtnactccatcagcagtgtatactggctggtcgcacgccccgaggagggttgagtggatgggagtancggatcganaggtgggagcacctaccgtacggtaacccctcctccgaccgacctcgacgtcgacagtacacaccagaaccacgtacccaaanaacctagttctacctgacggctagaacctcgttacgcgacccgaccgcaacgaccgacggccgtaatatttagtgtcggcgtacggtacttacggagggggttgagtaagtacggtacgggaccttaaaacgggtntttacggtacttccgttaccgtttacgaccgttaccgggtaacggggacccggtaaccggggtaaaccccgttcgggtccctaaccgggttccctccccg

SEQ ID NO: 335010 - DNA, 706 bp, Homo sapiens
  misc_feature: GZ8MTXP02IXRCQ.52.1.A01.1.454.CMB.2.raw
  modified_base (658)..(658): a, c, t, g, unknown or other
  misc_feature (658)..(658): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagcccttcggagatcatcgtcccctcacctgcctctgtctctggtcactccatcagcagtgtattacgtggctggtccgcacgccccgagggtaggttgagtggagttgggatgtcgatcacgaggtcgggacgacctacccgtacccgtacgaaacccccgttccctaccgaaccgaccgtaccgacgtacccgaccctaacttaacgtaccaacgacgaaacccgtaaccgtaacccgaaaacggtaaacctacggttacctacccgtaggtaacggtacgtacggaaaccttcgttcgaccggaaccccgccgaacgacgtaacccgaacgggtccccgttaattaaagtttgttacggtcggtaccggacccggggttaacgttccgggagggggttagtaaagttaagtacgggttcggtacgtacggttaactttcggttaactacccgttcgttacggaacctttaacgggnggggtacccgaacggggttaccctcgggttaccacccggttcttcccg

SEQ ID NO: 335011 - DNA, 733 bp, Homo sapiens
  misc_feature: GZ8MTXP02JCX2Y.52.1.A01.1.454.CMB.2.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagagtcatcactctacttcggccggactaagtcaggacgactaagtaagtaacgttaatttaagtacggtaaccaagaacgaaaccgaaggaaccgacccctagacctccgtagtactcgtagttcgtcgtactcctacgttgacgtgtacggttcgggtacctagtacgtaacgttccgaggttagactaggtacgtagtacgtaggggactaagtactaccgtactcgtaccacctactaccgtacctagtcctgaccgtaggccgtaggtaacgtttagttacgtaaaccttaacttttacctacgttaccgtaagtaaaccgttaggttaaaacccgttaccgtttaccccggtacccctttaaacgttcccggttttaacccgggcccggttaaaccggggtaactaacggtttaacggggtaacccttagttaaaaccggtaaccggtaaaaacgtcccggttagggtttaacccggaacgtttaacccggccctaaaccggtaccgtttaacgttcccgtttacgtttaacccc

SEQ ID NO: 335012 - DNA, 638 bp, Homo sapiens
  misc_feature: GZ8MTXP02GTHEG.52.1.A01.1.454.CMB.2.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccacgtgcagctgcaggagtcggcccaggactggtgaagccttcggagatcattcgtccctcacctgctctgtctctggtnacctcatcagctagttgtattacngggcctggtccggcacgcccccgagggaagggttgagtggagttgggagtntcgatcgacgagtcgggagtacccacccgtacctacgaaccccgtccctacgacgacccgtacgacgtacgcctatactcaacctagaaccaccgtacccaaacgtaacctagttacctaccctagacggtctacgtaaactcgtacgtcgaccccgccgacgacgaccgtaaccgggtacctaattaacgtttatcgttggaccggtggacccttagggagggtagacttagtagtggtactacgtaagtttcgtaaagttccgttaccgttacgtaaccgttacggcggggtaaccctacgggtaacccccgtggtacccgacccggttctttacccg

SEQ ID NO: 335013 - DNA, 680 bp, Homo sapiens
  misc_feature: GZ8MTXP02I0805.52.1.A01.1.454.CMB.2.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccagtgcagctgcaggagtcgggcccaggactggtgaagcccttcggagatcatcgtccctcacctgctntgtctctggtnactcatcagctagtgttattacgtggctgggtcgcacgccccgagggtacggttgaggtggagttgggagtagtcgatcacaggtggagaccgtacctacctcgaaaccccgtcccacaccgaccgtcgacgtcgaccatactacacacacaccggtaccaaacgtaacctacgttacctacccgtaggtacggtactacgtaaccttcgtaggttacccgacccggcccgacgacgaccgtaacccggggtacccgttaaacgttaagttttaacgttgggtcgggtacccggtacggggtaccgttaccgggtagggggttacggtaagttaagtacgggtacggtaccgttaagtacgttttacgtacgttcgtttaccgttacgtaaccgttacggtaacggggaccgtacggggtaaaccccgttggtacccgttaccggtcccgttaacccg

SEQ ID NO: 335014 - DNA, 617 bp, Homo sapiens
  misc_feature: GZ8MTXP02FVYP4.52.1.A01.1.454.CMB.2.raw
  modified_base (221)..(221): a, c, t, g, unknown or other
  misc_feature (221)..(221): n is a, c, g, or t
  modified_base (323)..(323): a, c, t, g, unknown or other
  misc_feature (323)..(323): n is a, c, g, or t
  modified_base (370)..(370): a, c, t, g, unknown or other
  misc_feature (370)..(370): n is a, c, g, or t
  modified_base (448)..(448): a, c, t, g, unknown or other
  misc_feature (448)..(448): n is a, c, g, or t
  modified_base (505)..(505): a, c, t, g, unknown or other
  misc_feature (505)..(505): n is a, c, g, or t
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtnactcatcagctagttggttattacgtgggccgtcgggtccggcgacgcccccgaggggtagggttgaggtggtagtgggagtgtcgacgtcagaggtgggancacctacgtccgaccccgtcccacgacgacctacgacgtcgacctanactcacacgacacgtaccaaacgaacctacgttactaccgtagacgtctaacggaaccttcgttgccggaccgcccgngacgacgacggtccttaattacgtttattcggtcgcggtaaccgggtcgttacgggngggggttagacgttagtaggtcggtacgtaacgtagttacgttattccgttacttacgaccgttacggcggggaccgaacgggtaacccgtggtccgtaccgttcctacccg

SEQ ID NO: 335015 - DNA, 652 bp, Homo sapiens
  misc_feature: GZ8MTXP02IZI7B.52.1.A01.1.454.CMB.2.raw
tcagcgcagtacgacacgaccggtgctcgatttagacgtctcatcagggggctttctgagagtcatggacctcctgtgcaagaacatgaagcacctgtggtttttcctcctgctggtggcagctccagatgggtcctgtcccagtgcagctgcaggagtcgggcccaggactggtgaagccttcggagatcatcgtccctcacctgctctgtctcgtgtcactcatcagctagtgttattacgtgggccgtgggtccgcgaccgccccgaaggggtagggttgaggtggtagtgggagtacgtcgatcgaacgaggtgggactaccgacccgtaccgaccgaaccccgtccctacgaccgacccgtcgacgtcgacctatactacgacacgaacaccgtaccaaacgaacctaagttaccctaccgtagacggtacgtactaaccgtcgtacgtaccgacccggccgacctacggaaccaccgggtaccttaattaacgttattcgggtacgaccggtccggtaacgtttaccggagggggttataacggtagtacggtcggtaaccgttacgtacgtttacgtacttcgttaccgttcgaaccgtaggtccggggacctaacgggtaccctggtaccaccgtccgtacccg

SEQ ID NO: 335016 - DNA, 581 bp, Homo sapiens
  misc_feature: GZ8MTXP02HAPXX.52.1.A01.1.454.CMB.2.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagcgcagtacgacacgaccggtgctcgatttagacgtctcatcagggggctttctgagagtcatggacctcctgtgcaagaacatgaagcacctgtggttttttcctcctgctggtggcagctcccagatgggtcctgtcccacgtgcagctgcaggagtcgggcccaggactgggtgaagccttcgggagatcatcgtccctcacctgcttctgtctcgtggtgactcatcagcagtgtatanggctggtcgcncgccccgagggagggttgagtggagtgggagtatcgatcacgagtgggagccaccgtaccgtacgaaccccgtccctacgacaccgtcgacgtacgaccaatactacacacgacaaccgtaccaaacgaacctacgttacctactgacggctagaacctcgtgtacgacgccgacgacgacgacggtacttactattacgtgtacgcgacggtactcggaggggtcgagtagtagtcggtactaggttaattcgttactccttccttacgacgttacggtcgggtaccgtacggggtaaccctgggtaccctacgtccgtaccc

SEQ ID NO: 335017 - DNA, 522 bp, Homo sapiens
  misc_feature: GZ8MTXP02JM7BA.52.1.A01.1.454.CMB.2.raw
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (349)..(350): a, c, t, g, unknown or other
  misc_feature (349)..(350): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagatcatcatcacttgccgggcaagtcagagcatagaactattaaatgtacacagaaccaggaaagcccctgactctgatctatgtcatcctacttgctgagtgggtcccatcaagtcgagtgcaggnggnacgtgganagtattccatctcacccnncacccagtcctncgagctgagtntttgctaaactcttatccgtanaactagtaacgttacagtttacccncttaaaccgttaggtccccttacggggaactacgtacgttcggtaaatacgtcaaacggtaaacctaggngtccgtaacnccgactatcttcgtaccttacg

SEQ ID NO: 335018 - DNA, 747 bp, Homo sapiens
  misc_feature: GZ8MTXP02JDISE.52.1.A01.1.454.CMB.2.raw
tcagcgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcaggagtccgggcccagggtactgggtagaacgtcccgttacggagtatcattcgtcccctcgacctgccttctgtctacgtggtcacctccatcagctaggttgttatacgtcggcgtaggtccgcacgccccgagggtaggttgaggtggagttgggagtagtcgatacgagtaggtgggaccgacctaaccctaccgtacccgtaccccgtcccgtaccgtacgtaccccgtaccggtaccgtccgacctactactacaccgagaaccaccgtaaccaacgtactacgttactacccgtgaacgtcctagactgtacgtacgacccgtcgaccgacgaccgtaaccggtaccttaagtttaacgtttgttacggtacgggtccggttacggggtaccggtttcggggtaacgggggttagtacggttaaaggtcggtacggtaccgttaacggtttaccgttacggttacgtttaccctttacccggttaacgttaaccggttaaccgggggttaaccggggaacccggtaaaccggggttacccggttacccggttaccggttaacccccggttccctttaacccccgg

SEQ ID NO: 335019 - DNA, 370 bp, Homo sapiens
  misc_feature: GZ8MTXP01EFZYF.39.37.D04.1.454.CMB.2.raw
  modified_base (364)..(370): a, c, t, g, unknown or other
  misc_feature (364)..(370): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccaggggaaccctggtcaccgtctcctcagcctccaccaaggcccatcggtcttcccctggcgccctgctccaggagcacctccgagagcacagcggccctgggctgcctggtcaaggctactcactagtgcgactgagcgggcctggcaaggcgcaatagnnnnnnn

SEQ ID NO: 335020 - DNA, 372 bp, Homo sapiens
  misc_feature: GZ8MTXP01AJY2G.39.37.D04.1.454.CMB.2.raw
  modified_base (363)..(363): a, c, t, g, unknown or other
  misc_feature (363)..(363): n is a, c, g, or t
  modified_base (369)..(372): a, c, t, g, unknown or other
  misc_feature (369)..(372): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtcttcccctggcgccctgctccaggagcacctccgagagcacagcggccctgggctgcctggtcaaggactacttccactagtgcgactgagcggggcctgggcaaggcgnaatagnnnn

SEQ ID NO: 335021 - DNA, 251 bp, Homo sapiens
  misc_feature: GZ8MTXP01BOALQ.39.37.D04.1.454.CMB.2.raw
  modified_base (250)..(251): a, c, t, g, unknown or other
  misc_feature (250)..(251): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcctcttcccgccatctgaactagtgcgactgagcgggctggcaaggcgcatagnn

SEQ ID NO: 335022 - DNA, 373 bp, Homo sapiens
  misc_feature: GZ8MTXP01AVEWL.39.37.D04.1.454.CMB.2.raw
  modified_base (280)..(280): a, c, t, g, unknown or other
  misc_feature (280)..(280): n is a, c, g, or t
  modified_base (368)..(373): a, c, t, g, unknown or other
  misc_feature (368)..(373): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtcttccccctggcgccctgctccaggancacctccgagagcacagcggccctgggctgcctggtcaaggactacttccactagtgcgactgagcgggcctggcaaggcgcaatagnnnnnn

SEQ ID NO: 335023 - DNA, 576 bp, Homo sapiens
  misc_feature: GZ8MTXP01D8LRR.39.37.D04.1.454.CMB.2.raw
  modified_base (432)..(432): a, c, t, g, unknown or other
  misc_feature (432)..(432): n is a, c, g, or t
  modified_base (483)..(483): a, c, t, g, unknown or other
  misc_feature (483)..(483): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtatttagaaggtgtccagtgtgcggtgcagttggtggagtctgggggaggcttggtccaggccgggggggtcctggagactctcctgtgcagcctctggattccccttacgagtattggctgagctgggtccgccaggctccgagggaggggttggagtgggtgccaacataaagcaagataggaagtccggaaagagtatctggaactctggtgaggggccgttcaccatctcagagacaacgcaagactccgtgcatcngacaaatcgaacagtctgagagccgaggacacgggtcttaggtttatacgnggcgcgaaggacggaaaggtccgtgggggccggttttcgaaccgttaaggtcgggggcccaagggggaccccttgggtcccaaccggttcccg

SEQ ID NO: 335024 - DNA, 369 bp, Homo sapiens
  misc_feature: GZ8MTXP01EPGOR.39.37.D04.1.454.CMB.2.raw
  modified_base (364)..(369): a, c, t, g, unknown or other
  misc_feature (364)..(369): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaaggcccatcggtcttcccctggcgccctgctccaggagcacctccgagagcacagcggccctgggctgcctggtcaaggactacttccactagtgcgactgagcggctggcaaggcgcaatagnnnnnn

SEQ ID NO: 335025 - DNA, 369 bp, Homo sapiens
  misc_feature: GZ8MTXP01CDS82.39.37.D04.1.454.CMB.2.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (364)..(369): a, c, t, g, unknown or other
  misc_feature (364)..(369): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactgggccagggaaccctggtcaccgtctcctcagcctccaccaaggcccatcggtctcccctggcnccctgctccaggancacctccgagagcacagcggccctgggctgcctggtcaaggactacttccactagtgcgactgagcgggcctggcaaggcgcaatagnnnnnn

SEQ ID NO: 335026 - DNA, 366 bp, Homo sapiens
  misc_feature: GZ8MTXP01CPL1L.39.37.D04.1.454.CMB.2.raw
  modified_base (277)..(277): a, c, t, g, unknown or other
  misc_feature (277)..(277): n is a, c, g, or t
  modified_base (364)..(366): a, c, t, g, unknown or other
  misc_feature (364)..(366): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaaggcccatcggtctcccctggcgccctgctccaggancacctccgagagcacagcggccctgggctgcctggtcaaggctacttccactagtgcgactgagcgggcctggcaaggcgcaatagnnn

SEQ ID NO: 335027 - DNA, 371 bp, Homo sapiens
  misc_feature: GZ8MTXP01BY93R.39.37.D04.1.454.CMB.2.raw
  modified_base (368)..(371): a, c, t, g, unknown or other
  misc_feature (368)..(371): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaagggcccatcggtcttcccctggcgccctgctccaggagcacctccgagagcacagcggccctgggctgcctggtcaaggactacttccactagtgcgactgagcgggcctggcaaggcgcaatagnnnn

SEQ ID NO: 335028 - DNA, 523 bp, Homo sapiens
  misc_feature: GZ8MTXP01A4175.39.37.D04.1.454.CMB.2.raw
  modified_base (286)..(286): a, c, t, g, unknown or other
  misc_feature (286)..(286): n is a, c, g, or t
  modified_base (517)..(523): a, c, t, g, unknown or other
  misc_feature (517)..(523): n is a, c, g, or t
tcagtcgcactagtcacgaccggtgctcgatttagtagcatactgttgggtttggggaggcttggtccagccggggggtccctgagactctcctgtgcagcctctggattcccctttacgagttattggctgagctgggtccgccaggctccagggaagggttggagtgggtggccaacataaagtaagatggaagtcggaaagagtatctggactctgtgaggggccgttcaccatctccagagacaacgccaaagaactccgtgcatctgcaaatgaacagtcngagagccgaggacacggctgtttatactgcgcgagagaaggactgggcggtttcgactacgtggggccagggaaccctggtcacgtctcctcaagcctcaccaagggcccatcgtctcccctgcgccctgctccaggagcacctcgagagcacagccggccgtggggctgccgtggtcaaggactactccactagtcgcgaactgaggcgggctgggcaaggcgcaatagnnnnnnn

SEQ ID NO: 335029 - DNA, 368 bp, Homo sapiens
  misc_feature: GZ8MTXP01DBBZ0.39.37.D04.1.454.CMB.2.raw
  modified_base (258)..(258): a, c, t, g, unknown or other
  misc_feature (258)..(258): n is a, c, g, or t
  modified_base (362)..(368): a, c, t, g, unknown or other
  misc_feature (362)..(368): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactggggcgtttcgactacgtggggccagggaaccctggtcacgtctctcagcctccacaaggcccatcggtcttccccnggcgccctgctccaggagcacctcgagagcacagccggccctgggctgcctggtcaaggactactccatagtgcgactgagcgggcctggcaaggcgcaatagnnnnnnn

SEQ ID NO: 335030 - DNA, 372 bp, Homo sapiens
  misc_feature: GZ8MTXP01DGC4C.39.37.D04.1.454.CMB.2.raw
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (365)..(372): a, c, t, g, unknown or other
  misc_feature (365)..(372): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccaggggaaccctggtcaccgtctcctcagcctccaccaaggcccatcggtcttcccctggccnccctgctccaggagcacctccgagagcacngcggcctgggctgcctggtcaaggctactccactagngcgactgagcgggctggcaaggcncaatagnnnnnnnn

SEQ ID NO: 335031 - DNA, 375 bp, Homo sapiens
  misc_feature: GZ8MTXP01CNLHL.39.37.D04.1.454.CMB.2.raw
  modified_base (280)..(280): a, c, t, g, unknown or other
  misc_feature (280)..(280): n is a, c, g, or t
  modified_base (369)..(375): a, c, t, g, unknown or other
  misc_feature (369)..(375): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggactgggcggtttcgactacgtggggccagggaaccctggtcaccgtctcctcagcctccaccaaggcccatcggtccttcccctggccgccctgctccaggancacctccgagagcacagcggccctggctcgcctggtcaaggctacttccactagtgcgactggagcggggcctggcaaggcgcaatagnnnnnnn

SEQ ID NO: 335032 - DNA, 370 bp, Homo sapiens
  misc_feature: GZ8MTXP01EBL4S.39.37.D04.1.454.CMB.2.raw
  modified_base (364)..(370): a, c, t, g, unknown or other
  misc_feature (364)..(370): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccacaaggcccatcggtcttcccctggcgccctgctccaggagcacctccgagagcacagcggccctgggctgcctggtcaaggctacttccactagtgcgactgagcgggcctggcaaggcgcaatagnnnnnnn

SEQ ID NO: 335033 - DNA, 252 bp, Homo sapiens
  misc_feature: GZ8MTXP01BM3J9.39.37.D04.1.454.CMB.2.raw
  modified_base (249)..(252): a, c, t, g, unknown or other
  misc_feature (249)..(252): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttcccgcatctgaactagtgcgactgagcgggctggcaaggcgcatagnnnn

SEQ ID NO: 335034 - DNA, 375 bp, Homo sapiens
  misc_feature: GZ8MTXP01EBBIE.39.37.D04.1.454.CMB.2.raw
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (366)..(375): a, c, t, g, unknown or other
  misc_feature (366)..(375): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtcttcccctggcnccctgctccaggancacctccgagagcacagcggccctgggctgcctggtcaaggactacttccactagtgcgactgagcgggctggcaaggcgcaatagnnnnnnnnnn

SEQ ID NO: 335035 - DNA, 370 bp, Homo sapiens
  misc_feature: GZ8MTXP01DA2MF.39.37.D04.1.454.CMB.2.raw
  modified_base (336)..(336): a, c, t, g, unknown or other
  misc_feature (336)..(336): n is a, c, g, or t
  modified_base (366)..(370): a, c, t, g, unknown or other
  misc_feature (366)..(370): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactggggcggtttcgactacgtggggccagggaaccctggtcacgtctcctcagcctccaccaaggcccatcggtcttcccctggccgccctgctccaggacgcacctccgagagcacagcggccctgggctgcctggtcaaggactacttccatagngcgactgagcggctggcaaggcgcaatagnnnnn

SEQ ID NO: 335036 - DNA, 618 bp, Homo sapiens
  misc_feature: GZ8MTXP01AIJRS.39.37.D04.1.454.CMB.2.raw
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (428)..(428): a, c, t, g, unknown or other
  misc_feature (428)..(428): n is a, c, g, or t
  modified_base (498)..(498): a, c, t, g, unknown or other
  misc_feature (498)..(498): n is a, c, g, or t
tcagtcgcactagtcacgaccggtgctcgatttagtagcatactgttgggtttgaggtctcagagaggagccttagccctggactccaaggcctttccacttggtgatcagcactgagcacacgaggactcaccatggaattggggctgagctgggttttccttgttggtattttagaaggtgtccagtgtgcggtgcagttggtggagtcgtgggggaggcttggtccaggccgggggggtccctgagactctcctgtgcagcctctggacttccccttagagtattggctgagctgggtccgcaggctccgagggaggggttgaggtgggtggcaacataaagcaagatggaagtccggaaagngtatctggaactcgtgngaggggccgttcacatctccagagacaacgccaaagactccggtnacatcagaacaaagtcgaaacgtagtcgtagagacggccggaaggaccgtacggtcttagtttactacgnggaacggacggaaggtaacgggaacgggtaccgggtcgggggttccggtttacggacccggttaacggggcgggggaacccggaacgggggtaccccttgggtccccgaacccggttccc

SEQ ID NO: 335037 - DNA, 369 bp, Homo sapiens
  misc_feature: GZ8MTXP01BPKZU.39.37.D04.1.454.CMB.2.raw
  modified_base (365)..(369): a, c, t, g, unknown or other
  misc_feature (365)..(369): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggactgggcggtttcgactacgtggggccaggaacctggtcaccgtctcctcagcctccaccaaggcccatcggtcttcccctggcgccctgctccaggagcacctccgagagcacagcggccctgggctgcctggtcaaggactcttccactagtgcgactgagcggggcctggcaaggcgcaaatagnnnnn

SEQ ID NO: 335038 - DNA, 549 bp, Homo sapiens
  misc_feature: GZ8MTXP01C4ZTN.39.37.D04.1.454.CMB.2.raw
  modified_base (402)..(402): a, c, t, g, unknown or other
  misc_feature (402)..(402): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccagccggggggtccctgagactctcctgtgcagcctctggattcccctttacgagttatggctgagctgggtccgcaggctcgagggaggggtggagtgggtgccaacataaagcaagatggaagtccggaaagagtatctggaactctggtgaggggcccggttcaccatcncagagacaacgcaagaactcgtgcatctgacaaatgaacagtctgagagccgaggacacgggtctgtttatacgtgcgcgagagaagggactggggcggtttcgacgtaacgtgggggccagggggacccttggtccgccgttcccg

SEQ ID NO: 335039 - DNA, 600 bp, Homo sapiens
  misc_feature: GZ8MTXP01D7HBY.39.37.D04.1.454.CMB.2.raw
  modified_base (270)..(270): a, c, t, g, unknown or other
  misc_feature (270)..(270): n is a, c, g, or t
  modified_base (515)..(515): a, c, t, g, unknown or other
  misc_feature (515)..(515): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcttgggttttccttgttggtattttagaggtgtccagtgtgcggtgcagttggtggagtcgtgggggaggtcgttggtccgaggcccggggggtccctggagactctcctgtgcagcctntggacttccccttagagtattggctgagcgtgggtccgcaggctccgagggaaggggttggagtgggtggccaaacataaagcaaagatggaaagtcggaaagagtatctggaacttcgtggtggacgggggtcccgttacaccgtatctaccagacgacaacgccaaagaactccgtgacatcagacaaaatcgaaacgtagtctagaagacgcccgaaggacacggcttgtttatacgtgcgngaggaggaaacggagtggggttcggtttcgaacgttaacggtcggggaaccgaacggggaaccccttgggtcccaaccggttccc

SEQ ID NO: 335040 - DNA, 251 bp, Homo sapiens
  misc_feature: GZ8MTXP01CQFHD.39.37.D04.1.454.CMB.2.raw
  modified_base (249)..(251): a, c, t, g, unknown or other
  misc_feature (249)..(251): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttccgccatctgaactagtgcgactgagcgggctggcaaggcgcatagnnn

SEQ ID NO: 335041 - DNA, 577 bp, Homo sapiens
  misc_feature: GZ8MTXP01BCGEH.39.37.D04.1.454.CMB.2.raw
  modified_base (307)..(307): a, c, t, g, unknown or other
  misc_feature (307)..(307): n is a, c, g, or t
  modified_base (561)..(561): a, c, t, g, unknown or other
  misc_feature (561)..(561): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctgagactctcctgtgcagcctctggacttcccctttagagtattggctgagctgggtccnccaggctccgaggggtaaggggttggagtgggtggaccaaacgataaaggcaaagataggaagtaccggaaagagtatcgtggaactctgtgggaggggtcccgttcaccatctccagagacaacgcaaagaactccgtagcatcagacaaatgaacagtctgagagccgaggacacgggtctgtttatactggcgcgaggaagagggacgtggggttcggtttcgacgtaacgtggggcccaggggtaccccngggtccaaccggtccc

SEQ ID NO: 335042 - DNA, 371 bp, Homo sapiens
  misc_feature: GZ8MTXP01CVA2C.39.37.D04.1.454.CMB.2.raw
  modified_base (280)..(280): a, c, t, g, unknown or other
  misc_feature (280)..(280): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (364)..(371): a, c, t, g, unknown or other
  misc_feature (364)..(371): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaagggcccatcggtctcccctggccgccctgctccaggancacctcgagcgcacagccggccctgggctgcctggtcaaggactacttccactagngcgactgagcggctggcaggcncaatgnnnnnnnn

SEQ ID NO: 335043 - DNA, 375 bp, Homo sapiens
  misc_feature: GZ8MTXP01AGDP5.39.37.D04.1.454.CMB.2.raw
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (368)..(375): a, c, t, g, unknown or other
  misc_feature (368)..(375): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtcttcccctggccnccctgctccaggancacctcgagagcacagcggccctgggctgcctggtcaaggactacttccactagtgcgactgagcgggcctggcaaggcgcaagtagnnnnnnnn

SEQ ID NO: 335044 - DNA, 538 bp, Homo sapiens
  misc_feature: GZ8MTXP01AC0PJ.39.37.D04.1.454.CMB.2.raw
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggatcacctttaggaactattggatgagttggtccgccgaggctgcgaggggaggggctgggaggtgggtggcccaaagagtagaggtagatagggaaagagaaagaaatctagtgtggactcgtgtaggaacgggccgattcacatctacagacacacgcaagaatcactgtattaacaatagaacngctagagngccgagacncgtctgttatacttgtgtgcggaagggggcaaggtggcgtgggcgttacgtcggggccgaaccgggg

SEQ ID NO: 335045 - DNA, 581 bp, Homo sapiens
  misc_feature: GZ8MTXP01DGVQI.39.37.D04.1.454.CMB.2.raw
  modified_base (447)..(447): a, c, t, g, unknown or other
  misc_feature (447)..(447): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggaggcttgggtccaggccgggggggtccctgagactctcctgtgcagcctctggactttcccctttacgagttattggctgagcgtgggtccgcaggctccgaggggaggggttggaggtgggtggaccaacataaagcaaagagtggaagtaccggaaagagtatctggaactcgtggtggacggggtccggttcaccatctccagagacaacgcaaagaactccgtancatctagacaaatgaaacagtcagagagccgaggacacggtcttgtttatacgtgcgcgagagaagggacgtggggttccggtttcgacgtaacggtgggggcccaaggggacccttgggtccgaaccggtccc

SEQ ID NO: 335046 - DNA, 732 bp, Homo sapiens
  misc_feature: GZ8MTXP01AFIGR.39.37.D04.1.454.CMB.2.raw
  modified_base (171)..(171): a, c, t, g, unknown or other
  misc_feature (171)..(171): n is a, c, g, or t
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
  modified_base (336)..(336): a, c, t, g, unknown or other
  misc_feature (336)..(336): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcgtggtttcgtgtaggtntttagaagtgtcagtgtgcggtgcagttggtggagtcgtgggggagcttggtccaggccggggggtccctgagctctcctgtgcngcctgtgtacttcccttagtagtgtggctgngcgtcggtccgcgcgcgtcgagggtaggggtggtggtggtcggacgaanaagtaagagaagagaggaaggaacggaagagtagtcgtgtacgtcgtggtgggtacgggtccggtaccgtacgtactacgtacgacgaacgaaccgaaccgaaccgaaaccgtaaccgtaccgtacgtactacgtacgtacgaacgtaaacgtaacgtaacggtaacggtacggtacggaacggaaccggaccggtaaccgggaccggtaccggttacgtttacgtttaacgtttaccggtacggtaaccggtaacggaacgggtaaacgggttaacgggtaacgggttacggggttaccgggtttaccggttaccgggttaaccggggtaccggggtaacccgggtaacccggggtacccgggttacccgggtaacccggttaaccccggtcccg

SEQ ID NO: 335047 - DNA, 252 bp, Homo sapiens; identical to SEQ ID NO: 335033
  misc_feature: GZ8MTXP01EA0LO.39.37.D04.1.454.CMB.2.raw
  modified_base (249)..(252): a, c, t, g, unknown or other
  misc_feature (249)..(252): n is a, c, g, or t

SEQ ID NO: 335048 - DNA, 564 bp, Homo sapiens
  misc_feature: GZ8MTXP01AXU24.39.37.D04.1.454.CMB.2.raw
  modified_base (337)..(337): a, c, t, g, unknown or other
  misc_feature (337)..(337): n is a, c, g, or t
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
  modified_base (558)..(558): a, c, t, g, unknown or other
  misc_feature (558)..(558): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcttggtccaggccgggggggtcctgagactctcctgtgcagcctctggacttccccttagagtatggctgagcgtgggtccgcaggctccgaggggaggggttggagtgggtgccaanataaagcaaagatgggaagtaccggaaagagtatcgtggaactcgtggtggacggggtccgttacacatctaccagacgacaacgaccaaagactccgngcagtctagacaaatgaacngtcgagagacgccgaggacacggtcttagtttactacgtgcgngagacgaggacgtggggcgtttcgacgtaacggtggggccgaagggacccttgggtccncggtcc

SEQ ID NO: 335049 - DNA, 366 bp, Homo sapiens
  misc_feature: GZ8MTXP01A7M7X.39.37.D04.1.454.CMB.2.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
  modified_base (364)..(366): a, c, t, g, unknown or other
  misc_feature (364)..(366): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtgggccagggaaccctggtcaccgtctcctcagcctccaccaaggcccatcggtcttccccnggcgccctgctccaggancacctcgagagcacngcggccctgggctgcctggtcaggactactcactagtgcgactgagcggggctgggcaaggcgnaagtagnnn

SEQ ID NO: 335050 - DNA, 556 bp, Homo sapiens
  misc_feature: GZ8MTXP01EBZZA.39.37.D04.1.454.CMB.2.raw
  modified_base (243)..(243): a, c, t, g, unknown or other
  misc_feature (243)..(243): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggtntccctgagactctcctgtgcagcctctggattccccttagagttattggctgagctgggtccncaggctcgagggagggttgagtgggtgccaanataaagcaagatggaagtcggaaagngtatcgtaggactcgtgtggaggggccgttcacatctcagagacacgcaagaactccgtncatctgacaatggaacngtctgagagccgaggacacggtctgtttatactgcgcgagagaaggacgttggggttcggtttcgaacgttacgtcgggggacccacggggaaccccttggggttcctaacccgg

SEQ ID NO: 335051 - DNA, 576 bp, Homo sapiens
  misc_feature: GZ8MTXP01BHRR7.39.37.D04.1.454.CMB.2.raw
  modified_base (341)..(341): a, c, t, g, unknown or other
  misc_feature (341)..(341): n is a, c, g, or t
  modified_base (368)..(368): a, c, t, g, unknown or other
  misc_feature (368)..(368): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggtttcttgttggtattttagaagtgtccagtgtgcggtgcagttggtggagtcgtggggggaggcgttgggtccgaggcccgggggggtccctggagactctcctgtgcagcctctggacttccccttagagttatggctgagcgtgggtccgcaggcctcgagggagggttggagtgggtgccaanataaagcaagatggaaagtcggaaagngtatcgtggaacttctggtgagggggcccgttacacccgtatcctaccaggacgaacgaacgccaaaggaacctccggtgaccatcagacaaatgaaacgngttcagaagcgccgagacaccggttnttagtttacncgngcgcgagagaacggtcggtcgggttcgttcgaccgtggcgggaaccgagggacccgttgtccgccgtc

SEQ ID NO: 335052 - DNA, 382 bp, Homo sapiens
  misc_feature: GZ8MTXP01CYKQV.39.37.D04.1.454.CMB.2.raw
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (371)..(382): a, c, t, g, unknown or other
  misc_feature (371)..(382): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcgtttcgactactggtgccagggaaccctggtcaccgtctcctcagcctccaccaagggcccatcggtcttcccctggcnccctgctccgaggagcacctcgagngcacagcggcccctgggctgcctggtccaaggacctacttcccatagtgcgactgaggccgggctgggcaaggcgactatgnnnnnnnnnnnn

SEQ ID NO: 335053 - DNA, 376 bp, Homo sapiens
  misc_feature: GZ8MTXP01EHL74.39.37.D04.1.454.CMB.2.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (371)..(376): a, c, t, g, unknown or other
  misc_feature (371)..(376): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaaggcccatcggtcttccccnggccncctgctccaggacgcacctccgagacgcacagccggccctgggctgcctggttaacgactacttccactagtgcgactgagcggggctcggcaaggcgcataagnnnnnn

SEQ ID NO: 335054 - DNA, 546 bp, Homo sapiens
  misc_feature: GZ8MTXP01AD0Z1.39.37.D04.1.454.CMB.2.raw
  modified_base (418)..(418): a, c, t, g, unknown or other
  misc_feature (418)..(418): n is a, c, g, or t
  modified_base (541)..(546): a, c, t, g, unknown or other
  misc_feature (541)..(546): n is a, c, g, or t
tcagtcgcactagtcacgaccggtgctcgatttagtagcatactgttgggtttgggggaggcttggtccagccgggggggtccctgagactctcctgtgcagcctctggattcccctttacgagttattggctgagctgggtccgccaggctccagggaagggttggagtgggtggccaacataaagcaaagatggaagtcggaaagagtatctggactctgtgaggggccgttcaccatctcagagacaacgccaagaactccgtgcatctgcaaatgaacagtctgagagccgaggacacggctgtttatactgcgcgagagaaggactgggcggtttcgactacgtggggccagggaacccccctggtcaccgtctcctcagccctccaccaagggccccagtcggcttcccccngcgccctgctccaggacgcacctccgagacgcacacgccggggccctggggcctggaccctgggtacaagggacctacttccactagtgcgacttggagcgggctcgggcagggcgcataagnnnnnn

SEQ ID NO: 335055 - DNA, 385 bp, Homo sapiens
  misc_feature: GZ8MTXP01C1JXB.39.37.D04.1.454.CMB.2.raw
  modified_base (367)..(367): a, c, t, g, unknown or other
  misc_feature (367)..(367): n is a, c, g, or t
  modified_base (376)..(385): a, c, t, g, unknown or other
  misc_feature (376)..(385): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggcttgtttattactgcgcgagagaaggactgggcgtttcgactacgtggggccagggaaccctggtccaccgtctcctcagcctccaccaaggcccatccggtcctccccctggccgccctgcctccaggacgcacctcgagacgcacagccggcctgggctgcctggtcaaggctacttccactagtgcgactgagcgggcctggacaaggccncaaagtagnnnnnnnnnn

SEQ ID NO: 335056 - DNA, 640 bp, Homo sapiens
  misc_feature: GZ8MTXP01CJT1M.39.37.D04.1.454.CMB.2.raw
  modified_base (355)..(355): a, c, t, g, unknown or other
  misc_feature (355)..(355): n is a, c, g, or t
  modified_base (513)..(513): a, c, t, g, unknown or other
  misc_feature (513)..(513): n is a, c, g, or t
  modified_base (567)..(567): a, c, t, g, unknown or other
  misc_feature (567)..(567): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcgttggtccgaggccgggggggtccctggagactctcctgtgcagcctctggactttccccttagagtatggctgagctcgggtccaccgaggcctccgaggggtagggggttggaggtgggtggaccaaanaagtaaagcaaagagtaggaagtaccggaaaggagtatcgtaggaacttcgtggtgggacgggggtcccggtttacacccgtatccctacccgaaggacgaaccaaccggaccaaaaggaaccctccggtgctaactctagaacctaaatcggaaacngttaccgtggaacggacgacccggaaggaccacgggtcttaggtttaactacgngcgacgagaggaggtacgtggggttccgttcgacgttaaggcggggccacggggaccttgggtccaaccgtcc

SEQ ID NO: 335057 - DNA, 696 bp, Homo sapiens
  misc_feature: GZ8MTXP01BYJZH.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccggggggtcctgagactctcctgtgcagcctctggacttccccttacgagttatggcttgagcgtgggtccgcaggctccgagggaggggttggaggtgggtggccaacgataaagcaagatggaagtaccggaaagagtatcgtggaaactcgtggtaggacgggggtcccgtttcaaccgtatcccgtacccgaaggacgaaccaaaccggacccgaaaacggtaaacccgttccccggttaggaccaacgttcgtacgaacctaaaagtcgaaacgtaggttaccgtaggaaggacgacccggaagggaaccgtaccgggtcttaggttttaactaacgttggaacggtcggaaaggaggaagggtacgttcggggggttacgtttaccggaaccgttccgggtcgggggaacccgaacgggggtaaccccttggggttaaccccgaacccgggtttcccc

SEQ ID NO: 335058 - DNA, 375 bp, Homo sapiens
  misc_feature: GZ8MTXP01BZOMR.39.37.D04.1.454.CMB.2.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (356)..(356): a, c, t, g, unknown or other
  misc_feature (356)..(356): n is a, c, g, or t
  modified_base (363)..(375): a, c, t, g, unknown or other
  misc_feature (363)..(375): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccacaaggccatcgtctccccnggcncctgctcaggncacctcgagagcacagccggccctgggctgcctggacaagggacctacttccacgtagtgcgactgagcgggctggacaaggcncaatagnnnnnnnnnnnnn

SEQ ID NO: 335059 - DNA, 362 bp, Homo sapiens
  misc_feature: GZ8MTXP01A90DR.39.37.D04.1.454.CMB.2.raw
  modified_base (265)..(265): a, c, t, g, unknown or other
  misc_feature (265)..(265): n is a, c, g, or t
  modified_base (355)..(355): a, c, t, g, unknown or other
  misc_feature (355)..(355): n is a, c, g, or t
  modified_base (361)..(362): a, c, t, g, unknown or other
  misc_feature (361)..(362): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaacccctggtcaccgtctcctcagcctccaccaaggcccatcggtcttcccctggcnccctgctccaggacgcacctccgagagcacagcggcctgggctgcctggtcaggctacttccactagtgcgactgagcggctggcaggcncaatgnn

SEQ ID NO: 335060 - DNA, 766 bp, Homo sapiens
  misc_feature: GZ8MTXP01DYZGY.39.37.D04.1.454.CMB.2.raw
  modified_base (475)..(475): a, c, t, g, unknown or other
  misc_feature (475)..(475): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggtcgttggtccgaggccggggggtcctgagactctcctgtgcagcctctggtactttccccttagagttatggctgagcgtcgggtccgcgaggctcgaggggtagggggttggaggtgggtgaccaacaataaagacaagagtaggaagtaccggaaagagtatcgtggaactcgtgggtggacgggggtcccgtttacacccgtatcgtacccagaacgaaccgaaaccggccaaaacggtaacccttcccggngacctatccgtagaaccaaaagtcgaaacgtaggttaccgtaggaacggaacggaccccggaagggaacccgtaaccgggggttctttaacggggtttttaactttaaccgtcggggaacccggtaacggggaaacgggtaaacggggttaaacgggggttaacccggggttcggggggtttaccccggggtttttaccggaaacccgggtttcccggggtacggggggaaccccggtaaaccggggggtaaaccccttcgggggtaaccccttaaccccgggtttccccg

SEQ ID NO: 335061 - DNA, 620 bp, Homo sapiens
  misc_feature: GZ8MTXP01AEKPJ.39.37.D04.1.454.CMB.2.raw
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (520)..(520): a, c, t, g, unknown or other
  misc_feature (520)..(520): n is a, c, g, or t
  modified_base (528)..(528): a, c, t, g, unknown or other
  misc_feature (528)..(528): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggagcttgggtccgaggcccgggggggtccctgagactctcctgtgcagcctctggactttccccttagagttattggctgaacgtgggtccgccaggctccgaggggtagggttggagtgggngaccaanataaagcaagataggaagtcggaaagngtatcgtaggactcgtgggtggacgggggtcccgttcaccatcctccaagagaaccaaccggccaaagacctcgagaccatacngaacaaatcgaaacngggtctggagacgccgaggaccgacggtcttaggtttattacgnggaccggngaaggacgggaaagggcgttgggggtccggtttacgacgttcgggcgggggacccaagggggtaccccttgggccctaacccgttcgtcccg

SEQ ID NO: 335062 - DNA, 382 bp, Homo sapiens
  misc_feature: GZ8MTXP01C35CJ.39.37.D04.1.454.CMB.2.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
  modified_base (375)..(382): a, c, t, g, unknown or other
  misc_feature (375)..(382): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtccaccgtctcctcagccctccaccaaggcccatccggtccttcccctggccnccctgctccaggancacctcgagagcacgagccggccctgggctgcctggtcaaggactacttccactagngcgactggagcggcctggacaaggcgcaaatagnnnnnnnn

SEQ ID NO: 335063 - DNA, 576 bp, Homo sapiens
  misc_feature: GZ8MTXP01DISKM.39.37.D04.1.454.CMB.2.raw
  modified_base (337)..(337): a, c, t, g, unknown or other
  misc_feature (337)..(337): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (499)..(499): a, c, t, g, unknown or other
  misc_feature (499)..(499): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcttggtccgaggccggggggtcctgagactctcctgtgcagcctctggacttccccttagagtatggctgagctgggtccgcaggctccgagggaggggttgagtgggtgccaanataaagcaaagatggaagtccggaaaagagtatctgggaactcgtggtggagggggcccggttcaccgatctaccagagacaacgccaaagaactccgtncatcngacaaatgaaacagtctagagacgccgtaggacaacggcttgtttataccgtgccgngagaagaaggtacgtggggccgtttgacgttaacggtggggcccaaggggtaaccccttggttcccgaaccggttcc

SEQ ID NO: 335064 - DNA, 605 bp, Homo sapiens
  misc_feature: GZ8MTXP01A8C4D.39.37.D04.1.454.CMB.2.raw
  modified_base (287)..(287): a, c, t, g, unknown or other
  misc_feature (287)..(287): n is a, c, g, or t
  modified_base (319)..(319): a, c, t, g, unknown or other
  misc_feature (319)..(319): n is a, c, g, or t
  modified_base (599)..(605): a, c, t, g, unknown or other
  misc_feature (599)..(605): n is a, c, g, or t
tcagtcgcactagtcacgaccggtgctcgatttagtagcatactgttgggtttgggggaggcttggtccagccgggggggtccctgagactctcctgtgcagcctctggattcccctttacgagttattggctgagctgggtccgccaggctccagggaagggttggagtgggtggccaacataaagtaagatggaagtcggaaagagtatctggactctgtgaggggccgttcaccatctcagagacaacgccaaagaactccgtgcatctgcaaatgaacagtcngagagccgaggacacggctgtttatactgcgngagagaaggacgtgggcggtttcgactacgtggggccagggaccctggtccacgtctcctcaacgccctccacccgaaacggggccccactccgggtcccttcccccgtgggcccgcccctgcctcccgaggacgtacccgacccgtccgacgacgccaacgacggcccgggccccggtggggccctcggcccgtggtaccgaacggtaccttaccttcccgtaacgttacgtcggccgaacgtggacggcggggcgtgggacaagggcggacaagtagnnnnnnn

SEQ ID NO: 335065 - DNA, 653 bp, Homo sapiens
  misc_feature: GZ8MTXP01CBBSC.39.37.D04.1.454.CMB.2.raw
  modified_base (489)..(489): a, c, t, g, unknown or other
  misc_feature (489)..(489): n is a, c, g, or t
  modified_base (543)..(543): a, c, t, g, unknown or other
  misc_feature (543)..(543): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctgagactctctgtgcagcctctggacttccccttacgtagttattggctgagcgtgggtccgccaggctccgaggggtaaggggttggaggtgggtggaccaacataaagcaagatagggaagtaccggaaagagtatcgtggaactcgtggtgggacgggggtcccggttcaccatctacccagacgaaccaacgcccaaaggtaacctcccggtgcctatctagactaaaatcgaaacgngttcgtggaagacggacccggaggaccaacggggtcttttagtttaacttacgnggtccggacgaagggaaggaacgggtaccggtgggggttccggttttcggaccgttaacgggtcgggggcccaaccgggggtacccttcggggtcccttaacccggttcc

SEQ ID NO: 335066 - DNA, 605 bp, Homo sapiens
  misc_feature: GZ8MTXP01C3J3N.39.37.D04.1.454.CMB.2.raw
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
tcagtcgcactagtcacgaccggtgctcgatttagtagcatactgttgggtttggggaggtctcagagaggagccttagccctggactccaaggcctttccacttggcgatcagcactgagcacagaggactcaccatggaattggggctgagctgggttttccttgttggtattttagggaagtgtccagtgtgcggtgcagttggtgtagtcgtggggggagcttgggtccaggccgggggggtccctgagactctcctgtgcagcctcgtggacttccccttagagtattggctgagcgtgggtccncaggctcgagggaggggttgagtggngcaaananaaagnaaganggaagtacggaaagagtatcnggaactgtggtgaggggtccgttcaccatcacagagacaacgcaaagactcgtncatcgagcaaaagtgaaataagtcgtagaacggaggcccgaaggacaacgggtcttaggtttatacgtggaacgcggaaggaaggaacgggtacggtcggggttacgggttttccggacgttaacgggacgggggcccgaacggggaccccttacgggttccgaaccccggttccg

SEQ ID NO: 335067 - DNA, 655 bp, Homo sapiens
  misc_feature: GZ8MTXP01B5MVN.39.37.D04.1.454.CMB.2.raw
  modified_base (522)..(522): a, c, t, g, unknown or other
  misc_feature (522)..(522): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctggttttcttgttggtattttagagtgtcagtgtgcggtgcagttggtggagtcgtgggggagcttggtccgaggccggggaggtccctgagactctcctgtgcagcctcgtggtacttccccctttagagtttatggctggagcgtcgggtccgccgaggcctccggagggggtaagggggttggaggtggggtcggaccaaacgagtaaaagcaaaggagtagggaaagtacggaaaagagtaatcgtagggactcgtgtgggacggggtcccgttacacctatcctaccagacgaacacgaccaaagaacctcgtgacatcctagaacaaatcggaaactgtacaggaagacggaccgaaggacncgggtcttagtttactgtggacgttacggaaaggacgggtaaacggtccggttgggggttccgttttacggaacgttaccgggtgggggaaccccgacggggttaaccccgttcgggttaacccgtaaccccg

SEQ ID NO: 335068 - DNA, 632 bp, Homo sapiens
  misc_feature: GZ8MTXP01DNT01.39.37.D04.1.454.CMB.2.raw
  modified_base (308)..(308): a, c, t, g, unknown or other
  misc_feature (308)..(308): n is a, c, g, or t
  modified_base (450)..(450): a, c, t, g, unknown or other
  misc_feature (450)..(450): n is a, c, g, or t
  modified_base (524)..(524): a, c, t, g, unknown or other
  misc_feature (524)..(524): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccgaggccgggggggtccctgagactctcctgtgcagcctctggacttccccttacgagttatggctgagctgggtccncaggctccgagggaaggggttggagtgggtgaccaacataaagcaagatggaagtaccggaaagagtatctggaaacttcgtggtggacgggggtccgttcaccatcctccagagaccaaacgccaaaggaactcccggtanactatcagaactaaagtgaaacgtagtcgaggaacggacgaccggaaggacgtacggtctttagtttactacgnggcggaggaaaggagggaacgggtcggttcgggggttaccgtttcggaacgttaacggggcgggggtaacccgaacggggtacccgttcgggtcccttaacccggtcc

SEQ ID NO: 335069 - DNA, 572 bp, Homo sapiens
  misc_feature: GZ8MTXP01AB18K.39.37.D04.1.454.CMB.2.raw
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggagcttggtccaggccggggggtcctgagactctcctgtgcagcctcgtggacttcccccttagagttattggctgagctgggtccncaggctcgagggagggttgagtggtggcaanataaagcaaagatggaagtccggaaagngtatcgnggaacttcgtgtgaggggccgttcaccagtcnccgagagacaacgcctaaagactccggancatcngaacaagagacgagtgtagagacgacgacgacgacgtcgttagttattacgtgcgacgagaggaacggtacggtcgggttcggttcgttacgtaacggtacgggccggacggtaccgttacgtccgttccgtccg

SEQ ID NO: 335070 - DNA, 779 bp, Homo sapiens
  misc_feature: GZ8MTXP01DK2T2.39.37.D04.1.454.CMB.2.raw
  modified_base (641)..(641): a, c, t, g, unknown or other
  misc_feature (641)..(641): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggaggcgttggtccgaggccggggggtccctgagactctcctgtgcagcctcgtggtactttccccttagagttagttggctgagtcgtcgggtcccgcgaggcctaccggaagggggtaagggggttgggaggttcgggggtcggacccgaaacgaaagtaaaacgcgaaaggtagtaggggaaaggtaaccgggaaaaggtagttaagtcgtaggaaacttcgtggtagggtacgggggtcccggttacaccgtactccgtacccgaaggaacgaaaccgaacccggaccaaaacggtaacccgttcccggtagacctaacgttcctaggaaacctaaaagttcggaaaccgtaggttaccgtaagggaacggaacggacccggaaggtaaccgtaccgggttctttaggttttaaactcggnggaaccggaacggaaaggacgggttaaacgggtccgggttacgggggttaccggttttccggaacgtttaacgggccggggggaacccctaacgggggtaaccccctttgggtaaccccgttaaccccggtttccccg

SEQ ID NO: 335071 - DNA, 674 bp, Homo sapiens
  misc_feature: GZ8MTXP01ANTZK.39.37.D04.1.454.CMB.2.raw
  modified_base (284)..(284): a, c, t, g, unknown or other
  misc_feature (284)..(284): n is a, c, g, or t
  modified_base (486)..(486): a, c, t, g, unknown or other
  misc_feature (486)..(486): n is a, c, g, or t
  modified_base (548)..(548): a, c, t, g, unknown or other
  misc_feature (548)..(548): n is a, c, g, or t
  modified_base (561)..(561): a, c, t, g, unknown or other
  misc_feature (561)..(561): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcgtggtttcgtgtaggtatttagaagtgtcagtgtgcggtgcagttggtggagtcgtgggggagcgttggtccgaggcccgggggggtcctgagactctccgtgtgcagcctctggtacttccccgttagngtattggctgagtcgtcgggtcccgccgaggcctaccggaagggggtaagggggttggaggtggggtcggacccaaagaagtaaacgagaaagagtagggaaagtccggaaaggagttatcgtggaacttcgtggtagggacggggtcccgttacaccgtattcgaccgagacgaccgtaacgcccaaagacccgttccggnactagtacgagaactaagtacgaacgtacggtacgaggacgacggtacgagtacgtacggtntttagttacgcgnggaacggaggaaggaacggttaacgggtcggtacggggttaccgttacggaccggtaacggggtacgggaacccggtaaccgggtacccgttcgtaacccgttaacccgtccg

SEQ ID NO: 335072 - DNA, 384 bp, Homo sapiens
  misc_feature: GZ8MTXP01BICL6.39.37.D04.1.454.CMB.2.raw
  modified_base (375)..(384): a, c, t, g, unknown or other
  misc_feature (375)..(384): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaagggcccatcggtcttcccctggccgccctgctccaggagcacctccgagacgcacagccggccctgggctcggcctggtcaaggtactacttccactagtcgcgactgaggcggctggcaagggcgcaatagnnnnnnnnnn

SEQ ID NO: 335073 - DNA, 644 bp, Homo sapiens
  misc_feature: GZ8MTXP01EKSZT.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccgaggccgggggggtccctggagactctcctgtgcagcctctggacttccccttacgagttatggctgagcgtgggtccgccaggctccgaggggaagggggttggaggtgggtggccaacataaagcaaagataggaagtaccggaaagagtatcgtggaactcgtggtggagggggccggttcaccatctccagacgaacaacgaccaaagaacctccgtgacactctagacaaatgaaacgagtactgagacgccggaggacgacggtcttagtttaacttacgtggccgcggaaggtaacggaaacgggtacgtcgggggttaccggttttccggaacgttaaccgggtacgggggaaccccgtaacgggggtaaccccgttcgggtaacccgttaacccgggttcccg

SEQ ID NO: 335074 - DNA, 459 bp, Homo sapiens
  misc_feature: GZ8MTXP01D3DP5.39.37.D04.1.454.CMB.2.raw
  modified_base (438)..(459): a, c, t, g, unknown or other
  misc_feature (438)..(459): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggcttgtttattactgcgcgagagaaggactgggtcgtttcgactacgtggggccacgggaaccctggtccaccgtctcctcacgccctaccaaccgaacggggcccctagttcccgggttcccttccccccgtgggcccgtcccctggccctccgaggacgccacctcggagagcacgacggccggccgtgggctcggcctggtaccaaaggtaccttaccgttccaacgttaggtcgacgtacgtggacgggccgggtctacgggacaagggtcccagtaaatgnnnnnnnnnnnnnnnnnnnnnn

SEQ ID NO: 335075 - DNA, 703 bp, Homo sapiens
  misc_feature: GZ8MTXP01CQB5W.39.37.D04.1.454.CMB.2.raw
  modified_base (505)..(505): a, c, t, g, unknown or other
  misc_feature (505)..(505): n is a, c, g, or t
  modified_base (692)..(692): a, c, t, g, unknown or other
  misc_feature (692)..(692): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattgggctgagctggttttccttgttggtattttagaaggtgtccagtgtgcggtgcagttggtggagtcgtgggggagcgttggtccgaggccggggggtccctgagactctcctgtgcacgccctcgtggtactttccccgtttacgtagttattggctggagtcgtcgggtcccgccaggccgtccggaagggggtagggggttgggaggtgggggtacggaccaaacgaagtaaagcgaaagagtaggaaagtaccggaaagagtatcgtggaacttcgtggtacgggacggggtcccggttacaccgtatccctacccgaagacgaaccaaaccggtaccaaacggaaccctccggtanactactccgttagaacgtaaatcgaaacgaggttccgaggaacgtaacggcccgaagggacctacgggtctttaggtttaactcgtggaaccggagaacggaagggaacgggtacggtcgggggttaccgttttcgaaccgtttaacggggcgggaaccgtaaccggggtaacccttgggtaacccncccggttaacc

SEQ ID NO: 335076 - DNA, 714 bp, Homo sapiens
  misc_feature: GZ8MTXP01C2D5P.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctggttttccttgttggtattttagaagtgtcagtgtgcggtgcagttggtggagtcgtgggggagcgttggtccgaggccggggggtccctggagactctcctgtgcagcctcgtggtacttcccctttagagttattggctgagtcgtgggtcccgcaggctccggaggggaagggggttggaggtggggtcggaccaaacgaagtaaaaggcaaagagtagggaaagtaccggaaaagtagtatacgtaggaacttcgtggtagggacgggggtcccggtttacaaccgtataccgtcccgaaaggaacgaaccaaaccgtaccgaaaggtaaaccctacccggtacgactaacttccgagaacctaaaagttcgaaaacgtacggttacgtaggaacggaaccggaccggaaacggaccgaaaccgggtctttaaggtttaacttaaccgtggaacgacggaggaaacggaaagggtaccgtggggttaccggtttcgaacgtttaacggcggggaacccgaacggggtaaccccgttggggtaacccaacccggttccc

SEQ ID NO: 335077 - DNA, 597 bp, Homo sapiens
  misc_feature: GZ8MTXP01AGO3A.39.37.D04.1.454.CMB.2.raw
  modified_base (288)..(288): a, c, t, g, unknown or other
  misc_feature (288)..(288): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (466)..(466): a, c, t, g, unknown or other
  misc_feature (466)..(466): n is a, c, g, or t
  modified_base (590)..(593): a, c, t, g, unknown or other
  misc_feature (590)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
tcagtcgcactagtcacgaccggtgctcgatttagtagcatactgttgggtttgggggaggcttggtccagccggggggtccctgagactctcctgtgcagcctctggatttcccctttacgagttattggctgagctgggtccgccaggctccagggaagggttggagtgggtggccaacataaagcaagatggaagtcggaaagagtatctggactctgtgaggggccgttcaccatctccagagacaacgccaaagaactccgtgcatctgcaaatgaacagtcngagagccgaggacacggcttgtttatacngcgcgagagaaggctgggcgtttcgacttacgnggggccagggaccccctggcaccgtctcccncacgccctaccaccgaacgggccccagttccgggtccttcccccgtcgcccgccctcgcctccgaggcgccaccgtccgacgacncacgacggccggggcccgtggggcctcggcccgtcggtacccaaagggtaccctaccgttcccgactacggtcgcgtacgttcggacggccgggtcgtcgggacgaacgggcgaacgataaggnnnngngn

SEQ ID NO: 335078 - DNA, 384 bp, Homo sapiens
  misc_feature: GZ8MTXP01EJMBR.39.37.D04.1.454.CMB.2.raw
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (372)..(384): a, c, t, g, unknown or other
  misc_feature (372)..(384): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggacgtgggcggtttcgactacgtggggccagggaaccctggtcaccgtctcctcacgcctccaccgaaggcccatcggtccttcccctggccaccctccncagcgcacncgngggcacgngcggcctggctgcctggtcaaggactacttccactagtgcgacgtgaggcgggctcggaccgaaggcgacatagnnnnnnnnnnnnn

SEQ ID NO: 335079 - DNA, 372 bp, Homo sapiens
  misc_feature: GZ8MTXP01DAFSH.39.37.D04.1.454.CMB.2.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (364)..(372): a, c, t, g, unknown or other
  misc_feature (364)..(372): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcgtttcgactacgtggggccaggggaccctggtcaccgtctcctcagcctccaccaagggcccatcggtctcccctggccnccctgctccagancacctcganagcacngccggcctgggctgcctggtacaaggctacttccactagtgcgactgagcgggcctggcaggcgcaatagnnnnnnnnn

SEQ ID NO: 335080 - DNA, 386 bp, Homo sapiens
  misc_feature: GZ8MTXP01E3FIJ.39.37.D04.1.454.CMB.2.raw
  modified_base (263)..(263): a, c, t, g, unknown or other
  misc_feature (263)..(263): n is a, c, g, or t
  modified_base (373)..(386): a, c, t, g, unknown or other
  misc_feature (373)..(386): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggtgccgagggaaccctggtcaccgtctcctcagcctccacaggcccatcggtcctcccctgccncctgctccaggagcacctccgagagcacaggccggccctgggcctgcccgtggtcaaggacctacttccacgtagtgcgactggacgcccgggctggcaaggcgacatgnnnnnnnnnnnnnn

SEQ ID NO: 335081 - DNA, 650 bp, Homo sapiens
  misc_feature: GZ8MTXP01ETGX5.39.37.D04.1.454.CMB.2.raw
  modified_base (554)..(554): a, c, t, g, unknown or other
  misc_feature (554)..(554): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggtttccttgttggtattttagaggtgtccagtgtgcggtgcagttggtggagtcgtggggaggcttggtccgaggccgggggggtccctggagactctcctgtgcagcctctggtacttcccctttagagttattggctgagcgtcgggtcccgcgaggcctaccggagggggtaagggggtttggaggtggggtaggacccaaacgaagtaaagcaaagagtaggaagtaccggaaagtagtatcgtggaactcgtggtgggacggggtcccggttcaccgtatctaccgagacgaacaaaccgccaaaggaacctcccggtagacattcagaacaaaagtcgaaacgagttcaggaaggacgacccggaggaccgacggtcttgtttaactacgngccggtagaaggaagaacgggacgttgggggttcgtttacgaccgttaagggcggggaaccgaacggggtaccccttgggtcccgttaaccgtccg

SEQ ID NO: 335082 - DNA, 711 bp, Homo sapiens
  misc_feature: GZ8MTXP01A3ESY.39.37.D04.1.454.CMB.2.raw
  modified_base (510)..(510): a, c, t, g, unknown or other
  misc_feature (510)..(510): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggtcgttgggtccgagggcccgggggggtcctggagactctccgtgtgcacgcctctggtacttccccgtttagagttattggctgagcgtgggtccgccaggcctccgagggggtaagggggtttggaggttgggggtcggaccaaacgaagtaaagcaaagagtaggaaaggtaccggaaaagtagtagtcgtagggaacttcgtggtacgggacggggtcccggttacaccgtacttcgacccaagaacgaaccaaaaccggcccaaaaggtaacctcccgggtanacctatacagaacaagtacgaacgtgtacgaggaacgccggacggaacggaccgtacggttcttagtttaactacgtgggaacccggaaggaaggaacgggttaaacgggtacgggttacgggggttacccggtttcgaaccgttccggggaccgggggaacccgtaacgggtaccccgttcgggtaaccccttcccgtcc

SEQ ID NO: 335083 - DNA, 734 bp, Homo sapiens
  misc_feature: GZ8MTXP01CYXRJ.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaggtgtccagtgtgcggtgcagttggtggagtcgtgggggaggcgttgggtccgaggccggggggtccctgagactctcctgtgcagcctcgtggtacttccccttagagttatggctgagcgtcgggtccgccaggcctccggaggggtaagggggttgggaggtgggggtcggaccaaacgaagtaaaaggcaaaggagtagggaaagtaccggaaagagtatcgtaggaacttcgtggtgggacgggggtcccgttcacctatcacccgagacgaaccaaaccggaccaaacgtaacccgtccggtagactaacgtctagaactaaagtacgaaacgtaggttccgtaaggaacggaacggaccccggaaagggtaaccgtaaccggggtcctttaaggtttttaaacttaccgtgggaaccggtcggaaaggaagggttaaacgggtaccgggttgggggttacccggttttaccggaaccggttaacgggtaccgggggaaccgaaacgggggtaccccgttcgggtaaccccgttaacccggttccccg

SEQ ID NO: 335084 - DNA, 927 bp, Homo sapiens
  misc_feature: GZ8MTXP01DBY48.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcgttgggttttccttgttggtattttagaaggtgtccagtgtgcggtgcgtaggttggtggagtcgtgggggagtcgttgggtccgagggcccggggggtccctggagtacctctccgtggtcgcacgtccctcgtggtactttccccgtttaggagttagtggcttggagtcgtcgggtcccgacgaggcctccggaaggggtaagggggtttggaagggttgggggtacggaccccaaaagtaaagaaaacggacgaaaaggtaagttaggggaaaaccggttaacgggaaaaaaggtacggtttaacgtaccggttacgggtaaaacccgtttcgttaagggggttacggggtaacccggggggggtttaccccgggttttaacccgaaaccccttaacgtttaccccgtaaacccggaaacggaaaaccggaaacccgaaaacccggggaacccaaaaacggtaaaaacccgttcccccggggttaaactaccgtaacgttaccgtaacgaaacgtaaaacgtaccgtaaaaccgggtacggttaccgtaagggaaaccggaaccgggaacccggtaacggtaaacccggttaaccggtttcgtttaaggtttaacctacggtcgggtaacggaacgggttaaaggggtaaacgggaaacgggttaccgggttacgggggttacccggttacgggttaacccggttaaccggggtaccggggtaacccgtaaccggggtaccccgttacgggttaacccgttccccgttcccg

SEQ ID NO: 335085 - DNA, 728 bp, Homo sapiens
  misc_feature: GZ8MTXP01AYZB7.39.37.D04.1.454.CMB.2.raw
tcagtcgcactagtcacgaccggtgctcgatttagtagcatactgttgggtttgaggtctcagagaggagccttagacctggactccaaggcctttccacttggtgatcagcactgagcacagaggactcaccatggaattggggctgagctgggttttccttgttggtattttagaaggtgtccagtgtgcggtgcagttggtggagtcgtgggggaggcgttggtccgaggcccgggggtccctgagctctcctgtgcacgtcctcgtcggtactttccccttagtagttatggctgacgcgtcgggtcccgccgaggtcctccggaggggtagggggttggaggtgggtcggaccgaaagaagtaaagcgaaagagtagggaagtaaccggaaaagtagtagtcgtaggtaacgttcgttgggtagggaccgggggtacccgttaccaccgtagtcctaccgaagaacgaactaacgttaccgaaacgaactaccgttctagtactacgtagaacctaaagtacgaaacgcggtacctaggaaccggccgacccggacggaacccgacgggtaccccttaagtaaccgtttacgtcgtaacgaaccgttaaacgtcccgttacccggtacgtttacgggttacgtttccgacccgttaaacccttacgtttcccgtaaccgttcccgggttaccggggtaacccgttaacccgggttaaccccgg

SEQ ID NO: 335086 - DNA, 685 bp, Homo sapiens
  misc_feature: GZ8MTXP01EHEDH.39.37.D04.1.454.CMB.2.raw
  modified_base (595)..(595): a, c, t, g, unknown or other
  misc_feature (595)..(595): n is a, c, g, or t
  modified_base (608)..(608): a, c, t, g, unknown or other
  misc_feature (608)..(608): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccgacggccgggggggtcccctggacgtactctcctgtgcacgcctctggactttcccccgtttaacgtagttattggcttggacgcgtgggtcccgccaggccgtccgaagggaagggggttggaggtggggtcggaccaaacaagtaaaacggacgtaaagagtagggaaaggtacccggaaaagagttaagtcgtaggtaaccttcgtggtagggaacggggtcccggtttacaacccgtatccgtacccaaggacgaaccaaacccgcctaaaaggaacccgttccgttacgcctaaagttccacgaacaaaagttcggaaactaagttccgtaggaacgaccggccggaagcctaaccggttntttagttactcgngcgagaagaggacggtcggtcgggttcgttcgacgtaacgggcgggaaccgacggtacccttggtaacccgcgtccg

SEQ ID NO: 335087 - DNA, 433 bp, Homo sapiens
  misc_feature: GZ8MTXP01EPHY3.39.37.D04.1.454.CMB.2.raw
  modified_base (420)..(433): a, c, t, g, unknown or other
  misc_feature (420)..(433): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggacgtgggtcggtttcgactacgtggggccagggaaccctggtcaccgtctcctcacgcctccaccaagggcccatccggtccttcccccgtggccgtccctgcctccgaggacgccacctcgagacgcacgacggccggcccctggggcctcggccccgttaggtaccaaacggtaccttaccgtttcccgaaccttaggtcgccgactggacggcgggccctgggacaagggcacaagtagnnnnnnnnnnnnnn

SEQ ID NO: 335088 - DNA, 739 bp, Homo sapiens
  misc_feature: GZ8MTXP01A9WL6.39.37.D04.1.454.CMB.2.raw
  modified_base (610)..(610): a, c, t, g, unknown or other
  misc_feature (610)..(610): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcttgggttttccttgttggtattttagaaggtgtccagtgtgcggtgcagttggtggagtcgtgggggaggcttggtccgaggccggggggtcctgagactctcctgtgcagcctctggtacttccccgttagtagttattggctgagtcgtcgggtcccgcgaggcgtccggaggggtaagggggttggaggtggggtcggaccaaacgaagtaaagcaaagagtaggaaggtaccggaaagagtatcgtaggaactcgtgggtagggacgggggtcccggttaccaaccgtacgttcctacccgagaacgaaaccaaacccggaccaaacggtaaccgttcccggtagacctagtaccgttagaaacctaaaagtcgaaacgtacggttaccgaggaacggaacggcccgggaaaggaacccgtacgggttactttacggttttaacttaccggngggaacggtacggaaaggtaagggttaacgggtaccggttcgggggttaccggtttccggaacgtaaccggggtccgggggaaccctaaaccgggggtaccccttggggtccccttaacccggttcccc

SEQ ID NO: 335089 - DNA, 741 bp, Homo sapiens
  misc_feature: GZ8MTXP01EPUSJ.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcttgggttttccttgttggtattttagaaggtgtccagtgtgcggtgcaggttggtggagtcgtgggggaggcgttggtccgaggccggggggtccctggagacctctcctgtgcacgcctcgtcggtactttccccgttaagagtagtggctgacgcgtcgggtcccgccgaggccgtccggaggggtaagggggttcggaggtggggtcgaccaaacgaagtaaagcgaaagagtagggaaacgtacggaaaagagtaagtcgtaggtaacttcgtggtagggacggggtccccggttacaaccgtactccgtacccgaagaacaaacccgaaccgaccgaaaacgtaacccgttccggtacgacctaacgttccgacgaaacgtaaaacgtcggaaaacccgttagggtacccgtaagggaacggaccggacccggaacgggaaccgtacggggttcttaacggtttttatacgtggaacggtaacggaaggacgggttaaggtccggttggggttaccgtttccgacgtaaccgggtcgggaacccgtacgggggtacccttcgggtaacccttcccggttccc

SEQ ID NO: 335090 - DNA, 411 bp, Homo sapiens
  misc_feature: GZ8MTXP01BQ3UU.39.37.D04.1.454.CMB.2.raw
  modified_base (389)..(411): a, c, t, g, unknown or other
  misc_feature (389)..(411): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggctgggcggtttcgactacgtggggccagggaaccctggtcaccgtctcctcacgcctccaccgaacgggcccagtccggtccttcccccgtgggccgtccctgcctccgaggacgccaccctcgagacgcacacgccggcccctgggcctgcctggtcaaggactactccatagtgcgactgaggcgggcctggacgaaggtcgacaatagnnnnnnnnnnnnnnnnnnnnnnn

SEQ ID NO: 335091 - DNA, 385 bp, Homo sapiens
  misc_feature: GZ8MTXP01EWC58.39.37.D04.1.454.CMB.2.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
  modified_base (376)..(385): a, c, t, g, unknown or other
  misc_feature (376)..(385): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaaatgaacagtctgagagccgaggacacggctgtttattactgcgcgagagaaggactgggcggtttcgactacgtggggccagggaaccctggtccaccgtctcctcagccctccaccaaggcccatcggtccttccccnggccncctgcctccaggagcacctccgagngcacaggccggcccctgggctgcctggtcaaggctacttccactagtgcgactgagcgggcctgggcaaggcncaagtagnnnnnnnnnn

SEQ ID NO: 335092 - DNA, 668 bp, Homo sapiens
  misc_feature: GZ8MTXP01BZOYG.39.37.D04.1.454.CMB.2.raw
  modified_base (532)..(532): a, c, t, g, unknown or other
  misc_feature (532)..(532): n is a, c, g, or t
  modified_base (573)..(573): a, c, t, g, unknown or other
  misc_feature (573)..(573): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggaggcgttggtccgagggccggggggtcctggagactctcctgtgcacgtcctcgtcggtacttccccgttacgtagtattggctgagtcgtcgggtccgccgacggcctaccggaagggggtaagggggtttgggaggttgggggtacggtaccaaacgaaagtaaagacgaaaggaagtagggaaacggtaccggaaagtagtaatcgtggaactcgtggtgggacggggccgttacacctatcgtaccaggaacgaacaaaccgacaaacggtacctcccgagaccagtctacgaataaactggaaacngttcgagacgagcccggaagcacggtcttagtttactacgngaacgtagaggtaacgaggtaccgtggggttaccgttcgaacggtcgggtccgggggccctaaacgggggtcccttaggtccccgttaacgtccc

SEQ ID NO: 335093 - DNA, 717 bp, Homo sapiens
  misc_feature: GZ8MTXP01EDEAX.39.37.D04.1.454.CMB.2.raw
  modified_base (708)..(708): a, c, t, g, unknown or other
  misc_feature (708)..(708): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggaggtcgttggtccgagggcccgggggggtccctgacgactctcctgtcgcacgcctcgtggtactttcccctttacgtagttatggctggacgcgtcgggtcccgccgaggccgtaccggagggggtaagggggttgggaagggtgggggtacggaaccctaaacgaaagtaaaaggacgaaaggagtagggaaagtaccgggaaaagtaggtatcgtaggtaacctcgtgggtcgggacgggggtcccggttacaccgtacgtccgtacccaaggaacgaaccaaaccggaccaaaacgtaaccctccggtagactacgtccgtagaactaaagtagaaacgtagttacgagggaacgacggccggaagtaccgacggtctttagtttactacgtgaacgtcggaaaggacgaagggtcgtggggttcccgtttacggaccgttaacgggtcgggaacccgaacggggtacccttgggtaaccccnccggttccc

SEQ ID NO: 335094 - DNA, 708 bp, Homo sapiens
  misc_feature: GZ8MTXP01C2NVP.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcttgggttttccttgttggtattttagaaggtgtccagtgtgcggtgcagttggtggagtcgtgggggagcgttggtccgagggcccggggggtccctgagactctcctgtgcagcctctggactttccccctttagagtattggctgagcgtgggtcccgcaggctccgaggggtaagggggttggaggtggggtggaccaaacgagtaaagcaaagagtagggaaagtaccgggaaaagagtatcgtggaaacttcgtggtgggacgggggtcccggttaccaaccgtattccgtacccgaagaacgaaccaaaccggacccaaaaggtaacccttcccggtgacctaagttcccgtagaacctaaaaagttcgaaaacgtcggttaccgtaggaacgggaacgccccgggaaaggtaccgacgggttcttagtttttaactacgtggaaccggacgttaaggaaggaaacgggtacggtgggggttaccggtttcgaacgtttaacgggcgggggaacccaacggggtaccccttgggtaacccaaccggttccc

SEQ ID NO: 335095 - DNA, 681 bp, Homo sapiens
  misc_feature: GZ8MTXP01AZWJS.39.37.D04.1.454.CMB.2.raw
  modified_base (268)..(268): a, c, t, g, unknown or other
  misc_feature (268)..(268): n is a, c, g, or t
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
  modified_base (481)..(481): a, c, t, g, unknown or other
  misc_feature (481)..(481): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcgtggtttctgttggtattttagaaggtgtccagtgtgcggtgcagttggtggagtcgtggggggagtcgttgggtccgagggtccgggggggtccctggagtactctccgtgtgacngtccctgtcggtactttcccccgtttaagattagtggactggacgccgtggggtcccnccgtaggcctcggaaggggagggggttgaggtgggtcgaccaagaataaagcaaagngtaggaagtccggaaatagtactgaggaactcgtgtgggacggggtccgttacactagtctaccagacgaaccaacggaccaaacggactacccggtnactacgtactaacgaactaaagtaacgaacggtaacgtacgtacggaacggaccggaccggaacggaacggtacgtacgttacgtttacgttacgtcgaacggacggaaggacggaacgggtacggtcgggttcggttcggttacggtaaccgggtacgggaaccggtaaccggtaccggttaccgtccgttcccgtccg

SEQ ID NO: 335096 - DNA, 684 bp, Homo sapiens
  misc_feature: GZ8MTXP01EYTP0.39.37.D04.1.454.CMB.2.raw
  modified_base (363)..(363): a, c, t, g, unknown or other
  misc_feature (363)..(363): n is a, c, g, or t
  modified_base (558)..(558): a, c, t, g, unknown or other
  misc_feature (558)..(558): n is a, c, g, or t
  modified_base (577)..(577): a, c, t, g, unknown or other
  misc_feature (577)..(577): n is a, c, g, or t
  modified_base (585)..(585): a, c, t, g, unknown or other
  misc_feature (585)..(585): n is a, c, g, or t
  modified_base (642)..(642): a, c, t, g, unknown or other
  misc_feature (642)..(642): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctggttttccttgttgtattttagaggtgtccagtgtgcggtgctagttggtggagtcgtgggggaggcttggtccgaggccggggggtcctgagctctcctgtgcagcctctggtacttcccctttacgagttagttggctgagcgtcgggtcccgccgacggccgtaccggagggggtaagggggttggaggtgggggtcgaccaaanaagtaaagcaaagagtaggaagtaccggaaagtagtatctggaacctcgtggtgggaggggcccgttcacctagtctaccgaagtacgaaccaaacggcccaaaggtaaccctccggtgtacaacgttcaggaactaaagtacgaaaccggtagttccgaggaacgaacggcccggaaaggtaccgaaccgggtntttacgtttaaatttcggngtaaccgngaagacggttaaagccgtaacgggttcggggttccgttttacgaacggttaccgggngggggaaccctacggggacccttcgggttccctaaccccggg

SEQ ID NO: 335097 - DNA, 420 bp, Homo sapiens
  misc_feature: GZ8MTXP01D4ATI.39.37.D04.1.454.CMB.2.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (390)..(390): a, c, t, g, unknown or other
  misc_feature (390)..(390): n is a, c, g, or t
  modified_base (399)..(420): a, c, t, g, unknown or other
  misc_feature (399)..(420): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactggggcgtttcgactacgtggggccagggaccctggtcaccgtctcctcagcctcacaggccatcgtctccccngccncctnctcagancaccncgagacncacgagccggcccctgggcctcgcccgtggtaccaaacgggtaccttaccttccaacgttacggtcggaccgtaccgtggacggtccggggccctggggacaagggccncgaaaatgnnnnnnnnnnnnnnnnnnnnnn

SEQ ID NO: 335098 - DNA, 662 bp, Homo sapiens
  misc_feature: GZ8MTXP01BTQWD.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagtcgttgggttttccttgttggtattttagaaggtgtcagtgtgcggtgcgtaggttggtggagtcggtgggggagtcgttgggtccgaggggtcccggggggtcctgacgtctctcgtgtcgcacgtcctctgttaccttcccgttagtattagtcggcttggacgtcggtcgggtcccgaccgaggtccgtacgggaagggggtagggggttggaggtcgggtacgaccaaaagtaagtaaagcgaaagacgtaggaaggtacggaaagtgtagtcgtggtaacttcggtgggtacgggaccggggtcccgttaccacgtacgttcaaacccgagaaccgtaaccgaacccggtacgaaacgtacccgtcgtgacttaactcgactaacaagtaccgaagtcgtgagacggacgcgagtacgacgtcttagttactgcgaagtacgagacggttagtcggtggttacgttgacgtggtccgggaacgtccggacttcggcccttcgtc

SEQ ID NO: 335099 - DNA, 370 bp, Homo sapiens
  misc_feature: GZ8MTXP02H7ZNV.39.37.D04.1.454.CMB.2.raw
  modified_base (262)..(262): a, c, t, g, unknown or other
  misc_feature (262)..(262): n is a, c, g, or t
  modified_base (350)..(350): a, c, t, g, unknown or other
  misc_feature (350)..(350): n is a, c, g, or t
  modified_base (365)..(370): a, c, t, g, unknown or other
  misc_feature (365)..(370): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaagggcccatcggtcttccccnggccgccctgctccaggagccacctccgagagcacagcggccctgggctgcctggtcaaggctactccatagtgcgactgagcgggcnggcaaggcgcatagnnnnnn

SEQ ID NO: 335100 - DNA, 248 bp, Homo sapiens
  misc_feature: GZ8MTXP02GU523.39.37.D04.1.454.CMB.2.raw
  modified_base (248)..(248): a, c, t, g, unknown or other
  misc_feature (248)..(248): n is a, c, g, or t
tcagtcgcactagtcacgaccggtgctcgatttagtagcatactgttgggtttgggacagacttcactctcaccatcagcagactggagcctgaagatttgcagtctatcactgtcagcagtatggtgactcaaagacgttcggccaagggaccaaggtggaaatcaaacgaactgtggctgcaccatctgtcttcatcttccgccatctgaactagtgcgactgagcgggctggcaaggcgcatagn

SEQ ID NO: 335101 - DNA, 561 bp, Homo sapiens
  misc_feature: GZ8MTXP02GPQGJ.39.37.D04.1.454.CMB.2.raw
  modified_base (556)..(561): a, c, t, g, unknown or other
  misc_feature (556)..(561): n is a, c, g, or t
tcagtcgcactagtcacgaccggtgctcgatttagtagcatactgttgggtttgggggaggcttggtccagccggggggtccctgagactctcctgtgcagcctctggattcccctttacgagttattggctgagctgggtccgccaggctccagggaagggttggagtgggtggccaacataaagcaagatggaagtcggaaagagtatctggactctgtgaggggccgttcaccatctccagagacaacgccaaagaactccgtgcatctgcaaatgaaacagtctgagagccgaggacacggctgtttatactgcgcgagagaaggactggggcggtttcgactacgtggggccagggaaccccctggtcaccgtctcctcagcctccaccaagggcccatcggtccttccccctgccgccctcgctcccgaggacgccacctccgagacgcacacggccggccccgtggggcctcggcccgtcggtacccaaagggacctacttcccacgtagtcgcgactggacggcgggctcgggcaaggcgaacatagnnnnnn

SEQ ID NO: 335102 - DNA, 627 bp, Homo sapiens
  misc_feature: GZ8MTXP02HX3ZZ.39.37.D04.1.454.CMB.2.raw
  modified_base (445)..(445): a, c, t, g, unknown or other
  misc_feature (445)..(445): n is a, c, g, or t
tcagtcgcactagtcacgaccggtgctcgatttagtagcatactgttgggtttgaggtctcagagaggagccttagccctggactccaaggcctttccacttggtgatcagcactgggcacagaggactcaccatggaattggggctgagctgggttttccttgttggtattttagaaggtgtccagtgtgcggtgcagttggtggagtcgtgggggaggcttggtccaggccgggggggtcctggagactctcctgtgcagcctctggacttcccctttacgagttattggctgagctgggtccgccaggctccgaggggaaggggttggaggtgggtggccaacataaagcaaagataggaagtacggaaagagtatcgtggactcgtgtgggacgggggccggttcaccatctccagagacaacgcaaagactcgtgcatcngacaaaatgaaacagtctagaagacgcccggaaggaccacgggcttagttttaatacgtggccgacggaaaggaagggaaacggaccggttagggggtccgggttttacggaaaccgttacgggtcggggggaccctaaacgggggtaaccccctggggtaccctaccccggttcttccccg

SEQ ID NO: 335103 - DNA, 370 bp, Homo sapiens
  misc_feature: GZ8MTXP02IWTKJ.39.37.D04.1.454.CMB.2.raw
  modified_base (365)..(370): a, c, t, g, unknown or other
  misc_feature (365)..(370): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaagggcccatcggtcttcccctggccgccctgctccaggacgcacctccgagagcacagcggccctgggctgcctggtcaaggctactccactagtgcgactgagcggctggcaaggcgcatagnnnnnn

SEQ ID NO: 335104 - DNA, 366 bp, Homo sapiens
  misc_feature: GZ8MTXP02GAQ86.39.37.D04.1.454.CMB.2.raw
  modified_base (363)..(366): a, c, t, g, unknown or other
  misc_feature (363)..(366): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtctcccctggccgccctgctccaggagcacctccgagagcacagccggccctgggctgcctggtcaaggacttccactagtgcgactgagcgggctggcaaggcgcatagnnnn

SEQ ID NO: 335105 - DNA, 546 bp, Homo sapiens
  misc_feature: GZ8MTXP02H64C0.39.37.D04.1.454.CMB.2.raw
  modified_base (339)..(339): a, c, t, g, unknown or other
  misc_feature (339)..(339): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (480)..(480): a, c, t, g, unknown or other
  misc_feature (480)..(480): n is a, c, g, or t
tcagtcgcactagtcacgaccggtgctcgatttagtagcatactgttgggtttgggaggtctcagagaggagccttagccctggactccaaggcctttccacttggtgatcagcactgagcacagaggactcaccatggaattggggctgagctgggtttccttgttggtattttagaaggtgtccagtgtgcggtgcagttggtggagtctgggggaggcttggtccaggccggggggtcctgagactctcctgtgcagcctctggacttccccttacgagttatggctgagctgggtccgccaggctccgagggaggggtggaggtgggtggccaanataaagcaaagatggaagtcggaaagagtatctggactcgtgtggaggggccggttcaccatctcagagacaacgccaaagactcgngcatcngacaaatgaacagtcagagagccgaagtacacggtcttagttatacgngcgagagacgaggcgtgggtcgttacgacgtaacggcggggaccacgggacctcggtaccaccgtc

SEQ ID NO: 335106 - DNA, 373 bp, Homo sapiens
  misc_feature: GZ8MTXP02JKZGA.39.37.D04.1.454.CMB.2.raw
  modified_base (366)..(373): a, c, t, g, unknown or other
  misc_feature (366)..(373): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaacccctggtcaccgtctcctcagcctccaccaagggcccatcggtcttcccctggcgccctgctccaggacgcacctccgagagcacagcggccctgggctgcctggtcaaggctacttccactagtgcgactgagcggcctggcaaggcgcatagnnnnnnnn

SEQ ID NO: 335107 - DNA, 590 bp, Homo sapiens
  misc_feature: GZ8MTXP02H3MOV.39.37.D04.1.454.CMB.2.raw
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttgggtccaggccggggggtcctgagactctcctgtgcagcctctggattccccttagagttattggctgagctgggtccgccaggctccgagggaagggttggagtgggtggccaaacataaagcaaagatggaagtccggaaagagtatctggacttctggtgagggggcccgttcaccatctccagagacaacgccaaagactccgtancatctgacaaatgaaaccngtctgagagccgaggacacggcttaggtttatactggacgacggaagaggaaacgggactcgggggtcgttttccgaacgtttaacggcgggggacccaacgggggtaaccccttcggggtacctaacccggttcc

SEQ ID NO: 335108 - DNA, 576 bp, Homo sapiens
  misc_feature: GZ8MTXP02JAC3M.39.37.D04.1.454.CMB.2.raw
  modified_base (461)..(461): a, c, t, g, unknown or other
  misc_feature (461)..(461): n is a, c, g, or t
  modified_base (535)..(535): a, c, t, g, unknown or other
  misc_feature (535)..(535): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaaggtgtccagtttgcggtgcagttggtggagtctgggggaggcttggtccaggccggggggtccctgagactctcctgtgcagcctctggacttccccttacgagttattggctgagctgggtccgccaggctccgaggggaaggggttggagtgggtggccaacataaagcaaagatgggaaagtcggaaaagagtatctagggactcgtgtggagggggtcccggttcaccatctccagagacaacgcaaagaactccgtagcatctgacaaatgaaacngtctgagagccgagacacggctgttatactgcgcgaggacgaaggtacgtggggccggtttacgacgttacggngggggcccaagggtacccctgggtaccaccggttctacccg

SEQ ID NO: 335109 - DNA, 545 bp, Homo sapiens
  misc_feature: GZ8MTXP02H68YL.39.37.D04.1.454.CMB.2.raw
  modified_base (453)..(453): a, c, t, g, unknown or other
  misc_feature (453)..(453): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccagccgggggggtccctgagactctcctgtgcagcctctggattccccttacgagttattggctgagctgggtccgccaggctccgagggaggggttggagtgggtggccaacataaagcaaagatggaagtcggaaaagagtatctggactctggtgagggggccggttcaccatctccagagacaacgccaaagaactccgtgcatctgcaaaatgaaacagtcngagagccgagacacggcttgtttatacgtgcgcgagagaaggactggggcgtttgacgtaacgtggggccaggggaccctgggtcaccggtc

SEQ ID NO: 335110 - DNA, 673 bp, Homo sapiens
  misc_feature: GZ8MTXP02JIFDB.39.37.D04.1.454.CMB.2.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (479)..(479): a, c, t, g, unknown or other
  misc_feature (479)..(479): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcgtggtttcctgttggtatttagaagtgtccagtgtgcggtgcagttggtggagtcgtgggggaggcttggtccaggccgggggggtccctggagactctcctgtgcagcctctggacttccccttacgagttattgggctgagcgtggggtccgccaggcctccgaggggtaaggggttggaggtggggtggccaaanataaaagcaaagntagggaaagtccgggaaaagagtatctggacttctggtagggacgggggtcccggttacaccgtattcctacccgaagacgaacccaacggacccaaaggaaacccttcccggngacctatcgagaactaaagtcgaaactagtacgtaggaacggacgacccggaaggtacgacggtctttagtttaactcgcggcgacgaagggaacggtaagggtacggttcgggggtaccggttttaccgaacggttaacgggcgggggaacccgtaaacgggggtaccccgtacgggtcccgacccggttccc

SEQ ID NO: 335111 - DNA, 251 bp, Homo sapiens
  misc_feature: GZ8MTXP02FU45A.39.37.D04.1.454.CMB.2.raw
  modified_base (250)..(251): a, c, t, g, unknown or other
  misc_feature (250)..(251): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttcccgccatctgaactagtgcgactgagcgggctggcaaggcgcatagnn

SEQ ID NO: 335112 - DNA, 639 bp, Homo sapiens
  misc_feature: GZ8MTXP02IOKT0.39.37.D04.1.454.CMB.2.raw
  modified_base (352)..(352): a, c, t, g, unknown or other
  misc_feature (352)..(352): n is a, c, g, or t
  modified_base (452)..(452): a, c, t, g, unknown or other
  misc_feature (452)..(452): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccgaggccgggggggtccctggagactctcctgtgcagcctctggattccccttacgagttattgggctgagcgtgggtccgccgaggctccgaggggaggggttggaggtgggtggccaaanataaagcaaagataggaagtaccggaaaagagtatcgtggactcgtggtggagggggcccgttcaccgatctccagagaaccaacgccaaagaacctcgngacatctagacaaatgaaactagtctagaaggacgccggaaggaccacgggcttagtttaactacgtcggtacgcgtaaaggacgtaaaaggggacgttcgggggtaccggttttaccgaacttaaccgggtacgggggaccccgaaacgggggtaacccccttggggttacccgacccgtttcccg

SEQ ID NO: 335113 - DNA, 563 bp, Homo sapiens
  misc_feature: GZ8MTXP02GYS7C.39.37.D04.1.454.CMB.2.raw
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaggtgtccagtgtgcggtgcagttggtggagtcgtgggggaggcttggtccaggccggggggtccctgagactctcctgtgcagcctctggacttcccctttacgagttattggctgagcgtgggtccgccaggcctccgaggggaggggttggagtgggtggaccaaacagtaaagcaaagataggaagtccggaaaagagtatctggactgtggtggagggggccgttcacctatcncagagacaacgcaaagactcgngcatcngacaaatgaaacagtcngagagccgagacacggcttagtttatacgtgcgcgagacgaaggacgtgggggtcgtttacgactaacggtcggggaccacggggaccctggtaccaccggtc

SEQ ID NO: 335114 - DNA, 360 bp, Homo sapiens
  misc_feature: GZ8MTXP02IZ4S6.39.37.D04.1.454.CMB.2.raw
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (354)..(360): a, c, t, g, unknown or other
  misc_feature (354)..(360): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggtcggtttcgactacgtggggccagggaaccctggtcaccgtctcctcagcctccacaggcccatcgtctccccngcncctgctccaggncacctcgagagcacngccgccctgggctgcctggtcaaggctacttccactagcncgactgagcggctggcaggcncatgnnnnnnn

SEQ ID NO: 335115 - DNA, 251 bp, Homo sapiens; identical to SEQ ID NO: 81900
  misc_feature: GZ8MTXP02F9QUW.39.37.D04.1.454.CMB.2.raw
  modified_base (250)..(251): a, c, t, g, unknown or other
  misc_feature (250)..(251): n is a, c, g, or t

SEQ ID NO: 335116 - DNA, 587 bp, Homo sapiens
  misc_feature: GZ8MTXP02ISZBF.39.37.D04.1.454.CMB.2.raw
  modified_base (264)..(264): a, c, t, g, unknown or other
  misc_feature (264)..(264): n is a, c, g, or t
  modified_base (360)..(360): a, c, t, g, unknown or other
  misc_feature (360)..(360): n is a, c, g, or t
  modified_base (391)..(391): a, c, t, g, unknown or other
  misc_feature (391)..(391): n is a, c, g, or t
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
  modified_base (520)..(520): a, c, t, g, unknown or other
  misc_feature (520)..(520): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccggggggtcctgagactctcctgtgcagcctntggactttccccttagagttattggctgagtcgtgggtccgccaggctccgaggggaggggttggaggtgggtggaccaaagagtaaagcaaaganggaagtaccggaaagagtatcgtggacttcnggtggaggggtcccgttacaccgtatctccgaagacgaacaaacgccaaaggaacctccgtgactaagtcagaactaaatgaaaacnggtctaggagacgccgtaagacncggtacttgtttaatacgngcgagagaggacgtggtcgggtcgttacgacgtcggcgggaccgaacggacctcggtacctaccgtc

SEQ ID NO: 335117 - DNA, 368 bp, Homo sapiens
  misc_feature: GZ8MTXP02GPXGB.39.37.D04.1.454.CMB.2.raw
  modified_base (365)..(368): a, c, t, g, unknown or other
  misc_feature (365)..(368): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggtgccagggaaccctggtcaccgtctcctcagcctccaccaagggcccatcggtcttcccctggcgccctgctccaggagcacctccgagagcacagccggccctgggctgcctggtcaaggctacttccactagtgcgactgagccgggctggcaaggcgcatgnnnn

SEQ ID NO: 335118 - DNA, 369 bp, Homo sapiens
  misc_feature: GZ8MTXP02H2U39.39.37.D04.1.454.CMB.2.raw
  modified_base (261)..(261): a, c, t, g, unknown or other
  misc_feature (261)..(261): n is a, c, g, or t
  modified_base (365)..(369): a, c, t, g, unknown or other
  misc_feature (365)..(369): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtcttccccnggcgccctgctccaggagcacctccgagagcacagcggcccctgggctgcctggtcaaggctacttccactagtgcgactgagcgggctggcaaggcgcatagnnnnn

SEQ ID NO: 335119 - DNA, 586 bp, Homo sapiens
  misc_feature: GZ8MTXP02IMGO3.39.37.D04.1.454.CMB.2.raw
  modified_base (347)..(347): a, c, t, g, unknown or other
  misc_feature (347)..(347): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcgtgggtttcctgttggtattttagaaggtgtccagtgtgcggtgcagttggtggagtcgtgggggaggcttgggtccaggccgggggggtccctgagactctcctgtgcagcctctggacttcccccttagagttattggctgagcgtgggtccgccaggctccgaggggaggggttggagtgggtggccaanagtaaagcaaagataggaagtccggaaaagagtatcgtaggacttcgtggtggagggggtcccgttcaccgatcctccgagagaaccaacgcctaaagaacctccgtgacatctgacaaatgaaacngtcngagacgccgaggacacggtcttagttatacgtgcgagagacgaaaggcgtggggtcgtttacgactaacggtcggggaccgacggggaaccctcgggtaccaccgtcc

SEQ ID NO: 335120 - DNA, 566 bp, Homo sapiens
  misc_feature: GZ8MTXP02HM785.39.37.D04.1.454.CMB.2.raw
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctggagactctcctgtgcagcctctggacttccccttacgagttattggctgagctgggtccnccaggctccgaggggaggggttggaggtgggtggaccaaanataaagcaaagagtggaaagtccggaaaagagtatcgtggactntggtggaggggccgttcacatctccaganaccaacgcaaagactccgncatcngacaaaatgaaacagtcagagagcccgaggacacggtcttagtttatacgngcgacgagacgaggtcgtcgggtcgttacgacgtcggcggggaccgacgggaccctcggtaccacgtc

SEQ ID NO: 335121 - DNA, 592 bp, Homo sapiens
  misc_feature: GZ8MTXP02JAFOU.39.37.D04.1.454.CMB.2.raw
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctggtttcctgttggtatttagaggtgtccagtgtgcggtgcagttggtggagtctgggggaggcttggtccgaggccggggggtccctgagactctcctgtgcagcctctggtacttccccttacgagttattggctgagcgtgggtccgccaggctccgaggggaaggggttggaggtgggtggaccaacgataaagcaaagatagggaagtaccgggaaaagagtatctggactcgtggtggaacgggggcccggtttcaccgtatctcccaagacgacaacgaccaaagaacctcgngacatcgtagacaaatgaactagtctagacgagccgaaggacgacggtnttagttatacgtcgacgacgaaggaacggaaggtacgtcggggtacgttacgacgtaacggcgggacgaccgggaccgtcggtccgacgtccg

SEQ ID NO: 335122 - DNA, 352 bp, Homo sapiens
  misc_feature: GZ8MTXP02JEN92.39.37.D04.1.454.CMB.2.raw
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (344)..(344): a, c, t, g, unknown or other
  misc_feature (344)..(344): n is a, c, g, or t
  modified_base (349)..(352): a, c, t, g, unknown or other
  misc_feature (349)..(352): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaggcccatcggtctccccngcncctgctcagncacncgagncacngccggcctggctgcctggtcaaggctacttccactagtgcgactgagcggctggcaggcncatgnnnn

SEQ ID NO: 335123 - DNA, 366 bp, Homo sapiens
  misc_feature: GZ8MTXP02G11KY.39.37.D04.1.454.CMB.2.raw
  modified_base (288)..(288): a, c, t, g, unknown or other
  misc_feature (288)..(288): n is a, c, g, or t
  modified_base (346)..(346): a, c, t, g, unknown or other
  misc_feature (346)..(346): n is a, c, g, or t
  modified_base (361)..(366): a, c, t, g, unknown or other
  misc_feature (361)..(366): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggtgccagggaaccctggtcaccgtctcctcagcctccaccagggcccatcggtcttcccctggccgccctgctccaggagcacctcganagcacagcgcctggctgcctggtcaaggactactccactagtgcgactgagcccgggntggcaaggcgcatgnnnnnn

SEQ ID NO: 335124 - DNA, 373 bp, Homo sapiens
  misc_feature: GZ8MTXP02F3PSE.39.37.D04.1.454.CMB.2.raw
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (367)..(373): a, c, t, g, unknown or other
  misc_feature (367)..(373): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaacccctggtcaccgtctcctcagcctccaccaagggcccatcggtcttccccnggccncctgctccaggagcacctccgagagcacagccggccctgggctgcctggtcaaggctacttccactagtgcgactgagcgggctggcaaggcgcatagnnnnnnn

SEQ ID NO: 335125 - DNA, 577 bp, Homo sapiens
  misc_feature: GZ8MTXP02IWU60.39.37.D04.1.454.CMB.2.raw
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtcctggagactctcctgtgcagcctctggacttcccctttacgagttattggctgagctgggtccnccaggctcgagggaggggttgagtggtggccaacataagcaagataggaagtcggaaagngtatcgtgactctggtgagggggccggttcaccgatctccagagacaacgcaaagactcgtgcatctgacaaatgaaacagtctgagacgccgaaggcacggtctagtttatactgcgacgaggagaaacggtctcgggggtacggttttcgaacgttaacggtcgggggaccctacgggggaaccccttgggtacccaccggtttcc

SEQ ID NO: 335126 - DNA, 594 bp, Homo sapiens
  misc_feature: GZ8MTXP02I6ZNU.39.37.D04.1.454.CMB.2.raw
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctgggtttcctgttggtattttagagtgtccagtgtgcggtgcagttggtggagtctgggggagcttggtccaggccggggggtcctgagactctcctgtgcagcctctggattccccttagagttatggctgagctgggtccncaggctcgagggaggtgagtggtgccaanataagcaagataggaagtaccggaaagagtatcgtggacttcgtggtcggagggggccgttacacctagtcctccaagacgacaacgccaaagaacctccgtgaccatctagacaaaagtgaaaccagtctaggacgagaccgaggaaccaggtcttaggtttaactacgtggaccgacggaaggtacggaacggtacgttcgggggtaccggtttacgaacgtaacggtcgggggacccgtacggggaacccctgggtaccctacggtccg

SEQ ID NO: 335127 - DNA, 373 bp, Homo sapiens
  misc_feature: GZ8MTXP02HXKC8.39.37.D04.1.454.CMB.2.raw
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (366)..(373): a, c, t, g, unknown or other
  misc_feature (366)..(373): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtccaccgtctcctnagcctccaccaagggcccatcggtcttccccnggcnccctgctccaggagcacctccgagagcacagcggccctgggctgcctggtcaaggctacttccactagtgcgactgagccgggctggcaaggcgcatagnnnnnnnn

SEQ ID NO: 335128 - DNA, 637 bp, Homo sapiens
  misc_feature: GZ8MTXP02JFZVV.39.37.D04.1.454.CMB.2.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (376)..(376): a, c, t, g, unknown or other
  misc_feature (376)..(376): n is a, c, g, or t
  modified_base (553)..(553): a, c, t, g, unknown or other
  misc_feature (553)..(553): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggagcttggtccaggccggggagtccctgagactctctgtgcagcctntggactttccccttagagtttatggctggagcgtgggtccncgaggctccgaggggagggttggagtgggtgacccaaagataaagcaaagagtaggaaagtcggaaaagngtatcgtaggactcgtggtagggacgggggtcccgttacaaccgtagtcctaccgagacgaccaaacgccaaagacctccgagactatctagaaccaaagtcgaaaccgtagttcgtaggaagacggacccggaaggaccgaacgggtcctttaggtttaacttaccgtggaccggnggaaaggacggaaaggccgttagggggtccggtttacgaacgttaacggcgggggaccaacggggaccccttgggacctacccg

SEQ ID NO: 335129 - DNA, 671 bp, Homo sapiens
  misc_feature: GZ8MTXP02F7Z4Z.39.37.D04.1.454.CMB.2.raw
  modified_base (316)..(316): a, c, t, g, unknown or other
  misc_feature (316)..(316): n is a, c, g, or t
  modified_base (484)..(484): a, c, t, g, unknown or other
  misc_feature (484)..(484): n is a, c, g, or t
  modified_base (577)..(577): a, c, t, g, unknown or other
  misc_feature (577)..(577): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcgtgggttttccttgttggtattttagaaggtgtccagtgtgcggtgcagttggtggagtcgtgggggagcttggtccgagggcccggggggtccctgacgactctcctgtgcagcctcgtggtactttccccgttacgtagttagttggctgagcgtgggtcccncgaggctcggaggggtaggggttggaggtgggtcgaccaagaagtaaagacaagagtaggaaggtacggaaaagagtatcgtaggacttcgtgggcgggacgggggtcccgttacacctactcctaccgaagaacaacccgaacgacccaaaaggaacccttccgganacctaagttccgacgaacaaaagttcgaaacgtacggttacaggaacgaacggacccggaaggaccgtacggttcttaggtttaacttacggnggtacggagaaggaacggtaacggtcggttcggggtaccgttacgaacggtaacgggcgggacccgacgggtacccgtcggtaccctaccgtcg

SEQ ID NO: 335130 - DNA, 367 bp, Homo sapiens
  misc_feature: GZ8MTXP02H8VEE.39.37.D04.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
  modified_base (359)..(367): a, c, t, g, unknown or other
  misc_feature (359)..(367): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtgggggccaggggaaccctggtccaccgtctcctcagcctccaccaaggcccatcggtcttccccnggcnccctgctcngncacncgagncangcgcccnggctgctggcaaggctacttccatagtgcgactggagcggggcctgggccaaggcnatagnnnnnnnnn

SEQ ID NO: 335131 - DNA, 669 bp, Homo sapiens
  misc_feature: GZ8MTXP02GD3QX.39.37.D04.1.454.CMB.2.raw
  modified_base (501)..(501): a, c, t, g, unknown or other
  misc_feature (501)..(501): n is a, c, g, or t
  modified_base (584)..(584): a, c, t, g, unknown or other
  misc_feature (584)..(584): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcgttggtccgagggcccggggggtccctgagactctccgtgtgcagtcctcgtggtactttccccttagagttattggctgagtcgtcgggtcccgccgaggcctaccggaggggtaacggggtttggaggttggggtcggacccaaaacgaagtaaaaggcgaaaggagtagggaaggttaccggaaaagtagtaactcgtaggaccttgtggtggacgggggtccgttacaaccatccgtaccgagaacgaacccgaacgacccaaagaaccgttcccgngacattcgagaacctaaagtcgaaacagttaccaggaaggaacgacccggaaggacctacgggtctttaagtttattaccggnggacggaggaagaacggacggtcggtcgggtacgtacgacgtaacggtcgggaccgtaaccgggtaccgtcggaccctaccgtcg

SEQ ID NO: 335132 - DNA, 664 bp, Homo sapiens
  misc_feature: GZ8MTXP02GZZLF.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattgggctgagctgggttttcttgttggtattttagaggtgtccagtgtgcggtgcagttggtggagtcgtgggggaggcttggtccagggccggggggtcctggagctctcctgtgcagcctctggacttccccttagagttattggctgagcgtcgggtccgccgaggcctaccgaggggtaaggggttggaggtggggtggaccaaacgaagtaaagcaaagagtaggaagtaccggaaaagagtatcgtaggactgtggtagggacggggtcccgttcacctatcctaccgaagacgaaccaacgaccaaagacccgtccgtgactagttccagaacaaaagtcgaaactaggtactaggaacggacgacccgaagggactacggtctttagtttaacgtacgtcggacgacggtaaaggagggaaacggtaccggttgggggtaccgtttaccggaacgttaacgggtcgggggaccctaacgggggtaacccccttgggtaccccgaccgtttcccg

SEQ ID NO: 335133 - DNA, 613 bp, Homo sapiens
  misc_feature: GZ8MTXP02INL8A.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccggggggtccctgagactctcctgtgcagcctctggacttccccttacgagttattggctgagcgtgggtccgccaggctccgaggggaaggggttggaggtgggtggccaaacataaagcaaagataggaagtacggaaaagagtatcgtggactcgtggtggacgggggtccggttcaccgatcctccgaagacgaaccaaacgccaaagaaacctccgtgacaatcagacaaaatgaaacagttcagagacgccgaagggacacggtcttagtttatacgtggcgacggaaggacgaaaaggggcttacgggggccgtttacgacgtaacggtcgggggacccaacgggggaacccctgggtacccaccggttcc

SEQ ID NO: 335134 - DNA, 651 bp, Homo sapiens
  misc_feature: GZ8MTXP02JX7RB.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccaggccgggggggtccctggagactctcctgtgcagcctctggacttccccttacgagttattggctgagctggtccgccaggctccgaggggaaggggttggaggtgggtggccaacgataaagcaaagatgggaagtaccggaaagagtatcgtaggacttctggtggacgggggtcccgttcacccatcctcccagacgaccaaacgccaaagaaccctcgtgcatcagacaaaatgaaactagtctagaaggacgccggaaggaccgacgggtcttaggttttaactacgtcggaccggacgaagggacggtaaaacgggcggttcgggggtaccggttttaccgaacgttaaccggggtcgggggaccccgaaacgggggtaacccccgttcggggtaccctaacccggtttccccg

SEQ ID NO: 335135 - DNA, 563 bp, Homo sapiens
  misc_feature: GZ8MTXP02HVS8Q.39.37.D04.1.454.CMB.2.raw
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccaggccggggggtccctgagactctcctgtgcagcctctggacttccccttacgagttattggctgagctgggtccgccaggctccgaggggaaggggttggaggtgggtggccaanataaagcaagatggaagtccggaaaagagtatctggactntgtgaggggccgttcaccatctccagagacaacgccaaagaacctcgtgcatctgacaaatgaaacngttcngagagccgagacacggtctagtttatactgcgcgaagagaaggacgtggggtccgtttacgacttaacgcgggggacccaacggggacccctggtccacccgttc

SEQ ID NO: 335136 - DNA, 367 bp, Homo sapiens
  misc_feature: GZ8MTXP02FNTMB.39.37.D04.1.454.CMB.2.raw
  modified_base (365)..(367): a, c, t, g, unknown or other
  misc_feature (365)..(367): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatcggtcttccccctggcgccctgctccaggagcacctccgagagcacagcggcccctgggctgcctggtcaaggactacttccactagtgcgactgagcggctggcaggcgcatagnnn

SEQ ID NO: 335137 - DNA, 632 bp, Homo sapiens
  misc_feature: GZ8MTXP02IIAP1.39.37.D04.1.454.CMB.2.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (439)..(439): a, c, t, g, unknown or other
  misc_feature (439)..(439): n is a, c, g, or t
  modified_base (490)..(490): a, c, t, g, unknown or other
  misc_feature (490)..(490): n is a, c, g, or t
  modified_base (534)..(534): a, c, t, g, unknown or other
  misc_feature (534)..(534): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcttgggttttccttgttggtattttagaaggtgtccagtgtgcggtgcagttggtggagtcgtgggggagcttggtccgaggccggggggtccctgagactctcctgtgcagcctctggactttccccttagagttatggctgagcgtgggtccnccaggctccgaggggaggggttggaggtggnggccaaacagtaaagcaaagatagggaagtaccggaaaagagtatcgtggactcgtgggtggaacgggggtcccggttcacccgtatcctaccgaggaanaccgaaacgccaaaggaacctcccgtgacaatcctagacaaaatgaaaacngttacgagagacgccgaaggaccacgggtcttagtttactacgngtaccgagaaggaggtaaacgggacgttgggggtaccgtttccgaaacgttccggcgggggaaccgtacggggtaaccccttgggtaccaccggtccc

SEQ ID NO: 335138 - DNA, 377 bp, Homo sapiens
  misc_feature: GZ8MTXP02H1UXU.39.37.D04.1.454.CMB.2.raw
  modified_base (230)..(230): a, c, t, g, unknown or other
  misc_feature (230)..(230): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (367)..(377): a, c, t, g, unknown or other
  misc_feature (367)..(377): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcgtttcgactacgtgggggccagggaaccctggtcaccgtctcctnagcctccaccaagggcccatccggtcttccccnggcnccctgctcaggncacctcgagncacagcggcccctgggctgcctggtacaaggcttacttccactagtcgcgactgagcgggcctggcaaggcgcatagnnnnnnnnnnn

SEQ ID NO: 335139 - DNA, 640 bp, Homo sapiens
  misc_feature: GZ8MTXP02JU9V1.39.37.D04.1.454.CMB.2.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (485)..(485): a, c, t, g, unknown or other
  misc_feature (485)..(485): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggagcttggtccaggccggggggtccctggagactctcctgtgcagcctctggtacttccccttagagttatggctgagctgggccnccaggcctccgaggggaggggttggagtgggtggaccaanataaagcaaagatagggaaagtaccggaaagagtatcgtaggacttcgtggtcgggagggggtcccgttacacctatcctaccgaagacgaacccaaacggaccaaagaaccgtccgtagctaagtcagactaaaatggaaacnggtctggacgagcccgaagggacacgggtcttagtttactacgtggacgtaggaagaggtaaacgggcgttacggggtacggttttacgaacgttaacgggacgggggacccgtaaacgggggacccccgttgggtaacccgtacccggtttccc

SEQ ID NO: 335140 - DNA, 371 bp, Homo sapiens
  misc_feature: GZ8MTXP02HQDNY.39.37.D04.1.454.CMB.2.raw
  modified_base (266)..(266): a, c, t, g, unknown or other
  misc_feature (266)..(266): n is a, c, g, or t
  modified_base (367)..(371): a, c, t, g, unknown or other
  misc_feature (367)..(371): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccaccaaggcccatcggtcttcccctggccnccctgctccaggacgcacctccgagagcacagcggccctgggctgcctggtcaaggactacttccactagtgcgactgagcgggctggcaaggcgcatagnnnnn

SEQ ID NO: 335141 - DNA, 621 bp, Homo sapiens
  misc_feature: GZ8MTXP02JXLG0.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggaggcgttggtccgaggccgggggggtccctggagactctcctgtgcagcctctggtacttcccctttagagttattggctgagcgtgggtcccgccgaggcctccgaggggtaaggggttggaggtggggtggacccaaacgataaagcaaagagtaggaaagtaccggaaaagagtatcgtggacttcgtggtggacgggggtccgttacaccgtatcctccgagacgaaccaaccgaccaaagaacctcccgtagcatcagacaaagtcgaaactagtctaggagacgaccgaggacacggtcttagtttatcgtagcgacggagaaggaacggacgtcggggtcgtttacggacgttcggtcggggacccgacggggtaccctggtaccacgttcgg

SEQ ID NO: 335142 - DNA, 560 bp, Homo sapiens
  misc_feature: GZ8MTXP02JCMKG.39.37.D04.1.454.CMB.2.raw
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcgttggtccgaggccggggggtccctgacgactctcctgtgcagcctcgtggacttccccttagagttatggctgagcgtgggtccgcaggctccgagggagggtgagtggtgcaananaagcaagataggaagtaccggaaagagtatcgtgacttcnggtggaggggccgttcaccatcnccagngacaacgcaaagactcgngcatcngacaaagtnaaacngtcagagagcccggagaccacggtnttagttactacgngacgaggaagacggaaggtcggtcgggtccgttacgacgtcggcgggaccgtacgggaccgtcggtaccacgtc

SEQ ID NO: 335143 - DNA, 620 bp, Homo sapiens
  misc_feature: GZ8MTXP02JSF2V.39.37.D04.1.454.CMB.2.raw
  modified_base (495)..(495): a, c, t, g, unknown or other
  misc_feature (495)..(495): n is a, c, g, or t
  modified_base (547)..(547): a, c, t, g, unknown or other
  misc_feature (547)..(547): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctgggttttccttgttggtattttagaaggtgtccagtgtgcggtgcagttggtggagtcgtgggggaggcttggtccaggccggggggtcctgagactctcctgtgcagcctctggacttccccttagagttattggctgagcgtgggtccgccaggcctccgaaggggtaaggggttgggaggtggggtcggaccaaaacgaagtaaaaggcgaaagtagtaggggaaaggtaccgggaaaagagttaatcgtggactcgtggtgggagggggcccgttacaccgtatcctaccgaagacgaacaacgacccaaaggaaccctccgtgctaatctgactaaaangaaacagtcaggagacgaccgaggaccacggtcttagtttactacgtgacgnggaagaggaaggtcgtggggtacgttacgacgtcggtcggggacctaacgggtacccgtggtcccaccgttcc

SEQ ID NO: 335144 - DNA, 376 bp, Homo sapiens
  misc_feature: GZ8MTXP02JM8EP.39.37.D04.1.454.CMB.2.raw
  modified_base (267)..(267): a, c, t, g, unknown or other
  misc_feature (267)..(267): n is a, c, g, or t
  modified_base (368)..(376): a, c, t, g, unknown or other
  misc_feature (368)..(376): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggactggggcggtttcgactactggggccaggggaacccctggtcaccgtctcctcagcctccaccaagggcccatcggtcttcccctggcnccctgctccaggacgcacctccgagacgcacagcgccctgggctgcctggtcaaggactacttccactagtgcgactgagcggacctgcaaggcgcatagnnnnnnnnn

SEQ ID NO: 335145 - DNA, 664 bp, Homo sapiens
  misc_feature: GZ8MTXP02FUK12.39.37.D04.1.454.CMB.2.raw
  modified_base (394)..(394): a, c, t, g, unknown or other
  misc_feature (394)..(394): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaggtgtccagtgtgcggtgcagttggtggagtcgtgggggaggcttggtccgaggccggggggtccctgagactctcctgtgcagcctctggacttcccctttagagttattggctgagcgtcggggtccgccaggctccggaggggtaaggggttgggaggtggggtcggaccaaacgagtaaaaggcaaagagtagggaagtaccggaaaagngtatcgtggacttcgtggtgggagggggtcccggttacacccgtagttcctccgaagacgaaccaaaccgaccaaaagaaccctccgtacgactaagtcctagacctaaaagtcggaaacagtccgtaggaacgacgacccggaaggaccgacggtcttaggtttaactacgtcggcgacgaaggaggaaagggacgttcgggggtacgtttacgaacgtaacggtcgggggaccgaacggggtaccccgtgggtaccctaccggttccg

SEQ ID NO: 335146 - DNA, 411 bp, Homo sapiens
  misc_feature: GZ8MTXP02HVRJN.39.37.D04.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (402)..(411): a, c, t, g, unknown or other
  misc_feature (402)..(411): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaacccctggtcaccgtctcctcagcctccaccaagggcccatcggtcttcccctggccnccctgctccgaggacnccacctccgagacgcacgacgccggcccctgggcctgccctggtccaaaggacctaccttccaacttagtcgcgactggacggcggggcccgtagggccaaaggggccgacgagtagnnnnnnnnnn

SEQ ID NO: 335147 - DNA, 699 bp, Homo sapiens
  misc_feature: GZ8MTXP02I8YIK.39.37.D04.1.454.CMB.2.raw
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaggtgtccagtgtgcggtgcagttggtggagtcgtgggggagcttggtccgagggcccggggggtccctggagacctctcctgtgcagcctcgtggactttcccccttagagttattgggctgagctgggtccncaggctccgagggagggttgagtgggtgcaanataagcaagatggaagtccggaaagagtatcgtggacttctggtagacgggggtccgttacaccgtatcctaccgagtacgaaccaaacgacccgaaagaaccctccggtagacctacttaccgtagaacctaaaagttcggaaaactaggttaccgtagggaaaggaccggaccggaaagggaacctaccggggtacctttaggttttaaatttaacccggcggtacggaacggaaagggaacggtaaacggggttacggttacgggggttaccgtttacggaaccggtaacggggtaccgggggaacccggtaaaccggggtacccgtaccgggtacccgtacccggttccg

SEQ ID NO: 335148 - DNA, 350 bp, Homo sapiens
  misc_feature: GZ8MTXP02GRF8J.39.37.D04.1.454.CMB.2.raw
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (344)..(350): a, c, t, g, unknown or other
  misc_feature (344)..(350): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactacgtggggccagggaaccctggtcaccgtctcctcagcctccacaggccatcgtctcccngcncctgcncngancactccgagngcacngcgcctggctgctgcaggctctccatagtgcgactgaggcgggcctggcaaggcgcatgnnnnnnn

SEQ ID NO: 335149 - DNA, 573 bp, Homo sapiens
  misc_feature: GZ8MTXP02FMFMY.39.37.D04.1.454.CMB.2.raw
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctggagactctcctgtgcagcctctggacttccccttacgagttattggctgagctgggtccaccaggctccgaggggaaggggttggaggtggggtggccaaacataaaagcaaagatagggaagtccggaaaagagtatctggactctgtgagggggccgttcaccatctccagagacaacgccaaagaactccgngcatcngacaaaatgaaacngtctagagagccgaggacacggcttagttaatactggcgcgagagaaagggactgggggacgtttcgactaacgtgggggaccagggggacccctgggaccaccggtcc

SEQ ID NO: 335150 - DNA, 643 bp, Homo sapiens
  misc_feature: GZ8MTXP02IW1ER.39.37.D04.1.454.CMB.2.raw
  modified_base (428)..(428): a, c, t, g, unknown or other
  misc_feature (428)..(428): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggtttccttgttggtattttagaaggtgtccagtgtgcggtgcagttggtggagtcgtgggggaggcttggtccgaggccgggggggtccctgagactctcctgtgcagcctctggacttccccttacgagtttattggctgagcgtgggtcccgccaggctccgagggaaggggttggaggtgggtggccaacataaagcaaagataggaagtccggaaagagtatctggacttcgtggtggacgggggtcccgttcaccatccgtcaganaccaacgcccaaagaactccgtgcagtctagacaaaatcgaaacagtctggaacgaggccgaggaccgacgggtcttaggtttaactacgtggaccgaggaagaaggtaaacgggtacggtcgggggttaccggtttttaccgaaccgttaacggtcgggggacccgaaacgggggtaacccccgtttacggggtaccctaaccccgggtttccc

SEQ ID NO: 335151 - DNA, 804 bp, Homo sapiens
  misc_feature: GZ8MTXP02FUQGA.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggtcttgggtccgagggcccggggggggtccctggagactctcctgtgcagcctcgtggtactttccccttagtagttattggctggagtcgtcggggtcccgccgaggcctccggaagggggtaaacgggggtttgggaggttgggggtcggacccgtaaaacgaagtaaaaggaccgaaaaggtaagtaaggggtaaaaggtaccggggaaaaaggtagtaagtcgtagggaaccttcgtgggtacgggacggggggtcccggttaccaacccgtatccgtcccaagggacaaacccgaaaccgaccgaaaaggtaacccttcccggatcgaattccgagaacctaaaaagttcgaaactacggtctagggaaacgggacgacccgggaaggggaacctaccgggggttctttaggtttttaactacggtcgggaacggaccggaaaagggaaggtaaaaccgggggtggtttaccggggggttaccggttttaaccggaaccggttaaccgggggtccggggggtaaccccgaaacgggggtaaccccctttcgggggtccccctaacccggtttccccg

SEQ ID NO: 335152 - DNA, 708 bp, Homo sapiens
  misc_feature: GZ8MTXP02H56N8.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcttgttggtattttagaaggtgtccagtgtgcggtgcaggttggtggagttcgtggggggaggtcgttgggtccgagggccgggggggtccctggacgctctcctgtgcagcctcgtggtactttccccttagagttatggctgacgcgtcgggtccgccgaggcctaccggaggggtacggggttggaggtggggtacggacccaaaacgaagtaaaaggcaaaggtagtagggaaacgtaccgggaaagtagtactcgtaggacttcgtgggtcgggaacgggggtcccgttacaccgtactccgtaccgaaggaacgaaccgaaccgaccaaaacggtaccttacccggtacgactactccgtagaacctaaaagtcgaaaccgtaggttacagggaaggacggacccggaagggaccgtacgggtactttaggtttaactacgtcggaccggaggaaggtagaaacgggtcgtcgggggtaccgtttcggaacgttaacgggcggggtaaccgacgggtaccctcgggtcctaaccggtccc

SEQ ID NO: 335153 - DNA, 663 bp, Homo sapiens
  misc_feature: GZ8MTXP02FN22F.39.37.D04.1.454.CMB.2.raw
  modified_base (312)..(312): a, c, t, g, unknown or other
  misc_feature (312)..(312): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccagggcccggggggtccctggagactctcctgtgcagcctctggacttcccctttagagtttattggctgagctgggtcccnccaggctccgaggggaaggggttggaggtggggtggccaaacataaagcaaaggataggggaaagtaccggaaaagagtaatcgtaggacttcgtggtggagggggtccggttcaccatcctaccagacgaaccaaccgccaaaagaaccctccgagctaatccagactaaaagtgaaacaggttctaggaacggacggacccggaaggtaaccacgggtacttaggttttaactaccgtgacggcggaaagacggaaacgggtacgttcgggggtacggttttacgaacgttaacgggtcgggggaccccctaaagggggtacccccttggggacccaacccggggtttc

SEQ ID NO: 335154 - DNA, 748 bp, Homo sapiens
  misc_feature: GZ8MTXP02F0CJ0.39.37.D04.1.454.CMB.2.raw
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggagcttgggtccaggccgggggaggtccctgagactctcctgtgcagccctntggacttcccctttagagttattggctgagctgggtcccncaggcctcgagggagggttgagtgggtgcaanataaagcaagngtggaagtacggaaagngtatcgtaggacttcgtggtcgggaacgggggtcccgttacgaacccgtattcccgtacccgaaagaacgaacccgaaaaccgacccaaaaggtaaaccctcccggtaagacctaatccgtagaaaccaaaagtcggaaaactagtccgtaagggaacgaacggcccggaaggaaccgacgggtacctttaagggttttaacttaaccggtcgggaccggtaccgggaaaggaaacgggtaaaacggggtccggttaaacggggggttcccgggtttttaaaccggaaacccggtttaaccgggtacggggggggaacccccgtaaaaacgggggttaacccccgtttcgggggtaacccctttaaacccccgggg

SEQ ID NO: 335155 - DNA, 655 bp, Homo sapiens
  misc_feature: GZ8MTXP02F5JVS.39.37.D04.1.454.CMB.2.raw
  modified_base (382)..(382): a, c, t, g, unknown or other
  misc_feature (382)..(382): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcttgggtccaggcccgggggggtccctggagactctcctgtgcagcctctggacttccccttagagttattggctgagctgggtccgccaggctccgaggggaaggggttggaggtgggtggccaaacgataaaagcaaagataggaaagtcggaaaagngtaatcgtgggaacttcgtgggtggacgggggtccggttacacccgatccgtaccagacgaaccaaaccggccaaaagaacctcccggtgacctaagttccagaaccaaaatcggaaaccagttcaggagacgacccgaggaccacgggtcttagtttaactacgtgacggcgaaggaaggaaacgggtcttgggggtaccgttttccgaaaggttccggtagggggacccctaacgggggtaacccccttggggtacccctaaccggttccc

SEQ ID NO: 335156 - DNA, 595 bp, Homo sapiens
  misc_feature: GZ8MTXP02GKU1E.39.37.D04.1.454.CMB.2.raw
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccaggccgggggggtccctggagactctcctgtgcagcctctggattccccttacgagttattggctgagctgggtccgcaggctccgaggggaaggggttggaggtgggtggccaaacgataaaagcaaagatagggaagtccggaaaagagtatctggacttcgtgtggaggggtccgttacaccgtatctccagagaaccaacgcccaaagaactccgngcatcagacaaatgaaacngtctgagagccgaaggacacggtctgtttatacgtgcgacggaagacgaaagggcgtacgggggccgtttacgaacgtaacgtcgggggaccaacggggtaccccgtggtacccgaccggttcc

SEQ ID NO: 335157 - DNA, 650 bp, Homo sapiens
  misc_feature: GZ8MTXP02FQ6VZ.39.37.D04.1.454.CMB.2.raw
  modified_base (349)..(349): a, c, t, g, unknown or other
  misc_feature (349)..(349): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctgagactctcctgtgcagcctctggacttccccttacgagttattggctgagctgggtcccgccaggcctccgaggggaaggggttggaggtggggtgaccaaanagtaaagcaaagatgggaaagtaccggaaaagagtatcgtaggacttgtggtggacgggggtccgttacaccgtatcctaccagacgaaccaacgaccaaagtaacctccgtcgactacgtctacgactaaaaagtgaaaaccgtgtacctaggagacggacccgagggaaccgaacgggtctttaggtttattacgcgacggacggaaggaaggaaacgggtcgtcgggggtacgtttacgacgttaacggtcgggggaccgaacgggggtaaccccctgggtaccgtacccggttcccg

SEQ ID NO: 335158 - DNA, 687 bp, Homo sapiens
  misc_feature: GZ8MTXP02H8FN2.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggaggcgttggtccgagggccggggggtccctggagactctcctgtgcagcctctggacttccccttacgagttatggctgacgcgtcgggtccgccgaggcctccggaggggtaggggtggaggtgggtggaccaaagataaagcaaagagtaggaagtccggaaaagtagtatcgtggactcgtgtagggacggggtcccgttacaccagtcctaccaagaacgaaccaaaccgaccaaaaggacccttccggtagacctatcgtagaacaaaagttcgaaactagttcgaggaacgacgggaccgaaagggaccacgggtactttagttttaacgtaaccgtcgggacgaacggaaggtaaacggaaaacgggtcggttacgggggtaccggttttcggaaaccgtaaccgggtacgggggacccgtaaacggggtacccctcggggtaccctaccccggtcccg

SEQ ID NO: 335159 - DNA, 562 bp, Homo sapiens
  misc_feature: GZ8MTXP02G7FFM.39.37.D04.1.454.CMB.2.raw
  modified_base (305)..(305): a, c, t, g, unknown or other
  misc_feature (305)..(305): n is a, c, g, or t
  modified_base (459)..(459): a, c, t, g, unknown or other
  misc_feature (459)..(459): n is a, c, g, or t
  modified_base (491)..(491): a, c, t, g, unknown or other
  misc_feature (491)..(491): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggtttccttgttggtattttagaaggtgtccagtgtgcggtgcagttggtggagtctgggggaggcttggtccaggccggggggtccctgagactctcctgtgcagcctctggacttcccctttagagttatggctgagcgtgggtccncaggctccgagggagggttggagtgggtgccaacgagtaaagcaaacagtaggaagtccggaaagagtatctggactcgtggtgaggggtccgttcaccatctccagacgacaacgccaaagaacctccgtagactatctgacaaaatgaaacngtctgagagccgagacacggcttgttatacgngcgacgagagaaggcgtggggtccgtttgactaacggtcggggaccaggggacccctggtacccacggtcc

SEQ ID NO: 335160 - DNA, 611 bp, Homo sapiens
  misc_feature: GZ8MTXP02JEEX0.39.37.D04.1.454.CMB.2.raw
  modified_base (362)..(362): a, c, t, g, unknown or other
  misc_feature (362)..(362): n is a, c, g, or t
  modified_base (519)..(519): a, c, t, g, unknown or other
  misc_feature (519)..(519): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcgtgggttttcctgttggtatttagaaggtgtccagtgtgcggtgcagttggtggagtcgtgggggagcttggtccaggccgggggggtccctgagactctcctgtgcagcctctggacttccccgtttagagttattggctgagtcgtgggtcccgccgaggcctccgaggggtaaggggtggaggtgggtggccaacgataaagcaaagngtggaagtcggaaagagtatctggactcgtggtggacgggggtccggttcaccgtattccgccagagaccgaaacgccaaagaacctccgtgccatcagacaaaagtgaaacagttcgagaggacgccggagggtaccacgggtctagtttatacgngacgtacgaagacggaaaggtccgtaggggtccggtttcgacgtaacggtcgggggacccacgggggtaacccctgggaccctacggtcccg

SEQ ID NO: 335161 - DNA, 614 bp, Homo sapiens
  misc_feature: GZ8MTXP02I9SX9.39.37.D04.1.454.CMB.2.raw
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
  modified_base (513)..(513): a, c, t, g, unknown or other
  misc_feature (513)..(513): n is a, c, g, or t
  modified_base (535)..(535): a, c, t, g, unknown or other
  misc_feature (535)..(535): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggtttctgttggtatttagaggtgtccagtgtgcggtgcaggttggtggagtcgtgggggagcttggccaggccggggagtccctgagactctctgtgcngcctntggacttccccttagagttatggctgagctgggtccncaggctacgaggggaagggttggaggtggggtcgaccaaagataaagcgaaaggagtagggaaacgtacgggaaaagagtatcgtagggacctggtgtaggggacgggggtcccgttacaaccgacttccgacccgaaaggaacgaaaccaaaccggacccaaaaggtaacctccggtagacctatccgtagactaaaagtcgaaaactgtacgngaacgacgacgagacgacggtnttagttatcgcgacgaggaagaaggtacggcgtcgggtccgttacgaacgtacggacggaccgaggtaccgtcgacacg

SEQ ID NO: 335162 - DNA, 653 bp, Homo sapiens
  misc_feature: GZ8MTXP02GTYRR.39.37.D04.1.454.CMB.2.raw
  modified_base (357)..(357): a, c, t, g, unknown or other
  misc_feature (357)..(357): n is a, c, g, or t
  modified_base (526)..(526): a, c, t, g, unknown or other
  misc_feature (526)..(526): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggaggcgttggtccgagggcccgggggggtccctggagactctcctgtgcagcctctggacttccccttacgagttatggctgagcgtggtccgccgaggctccgagggtagggtggagtgggtgcaacataaagcaaagntaggaagtaccggaaagagtatcgtaggactcgtggtggacgggggtccgttacaccatccgtaccgagacgaaccgaacgacccgtaaaggaacccttcggacgactaattcgacgactaaaatcgaaactagttccgagacggagacccggaaggaccgtaccggtntttagtttacttacgcggacgacggaacggaaggaaacgggtcggttcggggtacggtttaccgaacgttccggggacggggtacccgaacggggtaacccgtggtaaccccgtaccggtttccccg

SEQ ID NO: 335163 - DNA, 741 bp, Homo sapiens
  misc_feature: GZ8MTXP02HIQ56.39.37.D04.1.454.CMB.2.raw
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaagtgtccagtgtgcggtgcagttggtggagtcgtgggggaggcttgggtccgagggcccggggggtccctggacgactctccgtgtgcacgcctcgtggtactttccccgttagagtttagttcggcttggacgtcgttcggggtcccgccgaggtccgtaccgggaagggggtaagggggtttcgggaggttcgggggtacgggaccccaaaacgtaaagtaaaacggacgtaaaaggtaagtaggggaaaaggtaccgggaaaaggtagtactcgtaggacttcgtggtgggacgggggtcccgttanacccgtagtccnccgaaagacgaaaccgaaaccgaccgaaacggtaacccgtccgtcgactactctacgacaaaatcgaaacagtcgtagaacggacgccggaaggaccgtacggtcgttacgtttatacgtagaccggtaggaaggaaaggtaacggtacggtacgggggttccgtttaacggacgtaaccggggtccgggggtaccgtaaccgggggtaacccgtttcggtaacccgtacccggttcccg

SEQ ID NO: 335164 - DNA, 665 bp, Homo sapiens
  misc_feature: GZ8MTXP02F7DW1.39.37.D04.1.454.CMB.2.raw
  modified_base (517)..(517): a, c, t, g, unknown or other
  misc_feature (517)..(517): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccgaggccgggggggtccctggagactctcctgtgcacgcctcgtggtactttccccttacgagttatggctgagcgtgggtccgcaggctccgaggggtaggggtggaggtgggtggaccaacagtaaagacaaagagtaggaaggtaccggaaaagagtatcgtaggaacttcgtgggtggacgggggtccggttacaccgtatccgtacccgaagaacgaacccaaaccgacccaaacggtaacccttcccgagcctaattccgtagaacctaaaatcgaaacnggttacaggagaccgaccggaaggacacgggtactttagttaacttacgcggcggtacgaagggaaggaaacggtcgtacgggggttccgttacggaactaacgggtcgggggaccaacggggtaccctcgggtaccctacccggtcc

SEQ ID NO: 335165 - DNA, 606 bp, Homo sapiens
  misc_feature: GZ8MTXP02G81XY.39.37.D04.1.454.CMB.2.raw
  modified_base (460)..(460): a, c, t, g, unknown or other
  misc_feature (460)..(460): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctggagactctcctgtgcagcctctggacttccccttagagtttatggctgagctgggtccgccaggctccgagggaaggggttggagtgggtggccaacataagcaaagatggaagtccggaaagagtatctggactcgtggtggacgggggccggttcaccatcctccgagagacaacgccaaagaacctcgtgcaatctagacaaagtgaaacngtcagagagcccggaaggacgacggtcttaggtttaatacgtcggcggacggaaggacggtaaagggtacgtcgggggtaccggtttacggacttaacgggtcgggggaccgtaacggggaacccttgggtacccaccgtttcccg

SEQ ID NO: 335166 - DNA, 640 bp, Homo sapiens
  misc_feature: GZ8MTXP02IDZMZ.39.37.D04.1.454.CMB.2.raw
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccaggccggggggtccctgagactctcctgtgcagcctctggacttccccttagagttattggctgagctgggtccnccaggctcgagggagggttgagtgggtgccaacataaagcaaagatggaagtccggaaaagngtatctggactctggtgagggggtcccggttcaccgtatctcccagagacaacgccaaagaacctccgtagcatctagacaaaatcgaaacagttcaggaagacgcccggaaaggacacggggtactttggtttaacttacgaggccgacggaaaggacggaaaagggtccggttacgggggtccgggtttttaccgaaaccgtttaacggggtcgggggaaccccgtaaacgggggtaaacccccgttgggtaccctaacccgggtttcccc

SEQ ID NO: 335167 - DNA, 371 bp, Homo sapiens
  misc_feature: GZ8MTXP02IXDZ4.39.37.D04.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (365)..(371): a, c, t, g, unknown or other
  misc_feature (365)..(371): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcgtttcgactacgtggggccaggggaacccctggtccaccgtctcctcagcctccaccaaggcccatcggtccttccccnggcnccctgctccaggagcacctccgagagcacngcggccctggctgcctggtcaaggctactccactagtgcgactgagcggctggcaaggcgcagtagnnnnnnn

SEQ ID NO: 335168 - DNA, 664 bp, Homo sapiens
  misc_feature: GZ8MTXP02FR7F3.39.37.D04.1.454.CMB.2.raw
tcagtcgcactagtcacgaccggtgctcgatttagtagcatactgttgggtttggggaggtatcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggaggtcgttggtccgagggcccgggggggtccctggacgactctcctgtgcagcctcgtggtactttccccgttagagttattggctgagtcgtgggtcccgcgacggtctacggaggggtaggggttggaggtgggtcgaccaaacagtaagacaaagagtaggaagtaccggaaagtagtatcgtgactcgtggtgggacgggggtccgttaccaccgtatccgtacgaaagacgaacgaacccgaccaaaagacccgttccgagactacttccgagaactaaaacgtcgaaactagttcgaagaacgggacgacccggaggacgtcggttacttagtttactagcggtacgaggaaggtaacgggaaaggtcggttacggggtaccgtttacgaaccggttgggaccgggaccggtaaccggacctggacctaccgtaccccg

SEQ ID NO: 335169 - DNA, 612 bp, Homo sapiens
  misc_feature: GZ8MTXP02HZIXS.39.37.D04.1.454.CMB.2.raw
  modified_base (388)..(388): a, c, t, g, unknown or other
  misc_feature (388)..(388): n is a, c, g, or t
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
  modified_base (501)..(501): a, c, t, g, unknown or other
  misc_feature (501)..(501): n is a, c, g, or t
  modified_base (520)..(520): a, c, t, g, unknown or other
  misc_feature (520)..(520): n is a, c, g, or t
tcagtcgcactagtcacgaccggtgctcgatttagtagcatactgttgggtttggggaggtctcagagaggagcccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcgttggtccagggccgggggggtcctgagactctcctgtgcagcctctggactttccccttacgagttattggctgagcgtgggtccgccgaggcctccggaggggtaggggttggaggtggggtggaccaaacgataaagcaaagagtggaagtcggaaaagngtatcgtggacttcgtgggtgagggggtcccggttacaccgtntctccagacgacacgaccaaagtactccgncatctagacaaatgaacagtcagagacgcgaggacacgtnttagtttatcgtggaccgnggaagtaggaacgggtacgtcgggggtacggtttcgaacgttcggtcgggggacccgtacgggggaaccccttggggtaccacccggttccc

SEQ ID NO: 335170 - DNA, 749 bp, Homo sapiens
  misc_feature: GZ8MTXP02FTVTU.39.37.D04.1.454.CMB.2.raw
  modified_base (311)..(311): a, c, t, g, unknown or other
  misc_feature (311)..(311): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggaggcttggtccgagggccggggggtccctggagactctcctgtgcagcctctggtacttcccccttagagttattgggctgagctgggtccncaggctcgagggagggtgaggtggtgccaacataaagcaaagatagggaagtccggaaaagagtaatcgtaggacttcgtgtcgggacgggggtccggttaccaaccgtatccgtacccgaagacggaaacccaaaccggaccaaaacggtaacccgttcccggtaggaccctaagttccaggaaccaaaagttcgaaaacctaggtcctagggaacggacggaccccgaaggggaccctaaaccggggtttctttaggtttaacttaccggtcggtaccggacggtaaagggaacgggtaaacggggttaccgggttcggggggtttacccggttttaaccggtaaaacccggttaaccgggggtaccgggggtaaaccccggtaacccgggggtaaacccccgttcgggggttaaccccgtaccccggttaccccg

SEQ ID NO: 335171 - DNA, 702 bp, Homo sapiens
  misc_feature: GZ8MTXP02G0TM6.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggaggtcgttgggtccgagggcccgggggggtccctggacgtactctccgtgtgcacgcctcgtcggtacttccccgttagtagttagtggctgacgtcgtcgggtcccgccgaggcctccggaaggggtaggggttggaggtggggtacggacccgaaacgaaagtaaaacgcgaaaggagtagggaaaggtaccggaaaagagttatcgtaggtaacttcgtggggtcgggaacgggggtcccggttacaccgtactccgtaccgaagacgaaaccaacgaccgaaaagacccgtccgtagacctatctagaactaaaagtcgaaaccgtgtagagaacgggacgaccggaaggaccgtacgggtcttttagttaactcggcgaccggtaggaaggaacgggtaaacggcggttcggggtaccgttacgacgttaacgggtcggggaacccgtacgggtacccgttcggcccgtaacgtccccg

SEQ ID NO: 335172 - DNA, 651 bp, Homo sapiens
  misc_feature: GZ8MTXP02GTFSW.39.37.D04.1.454.CMB.2.raw
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (549)..(549): a, c, t, g, unknown or other
  misc_feature (549)..(549): n is a, c, g, or t
  modified_base (565)..(565): a, c, t, g, unknown or other
  misc_feature (565)..(565): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggaggcgttgggtccgagggcccgggggggtccctggagacctctcctgtgcagcctctggactttccccctttacggagtttattgggctggagcgtggggtcccgccgaggcctccgaaggggaagggggttggaggtggggtggacccaaacgagtaaaaggcaaagagtaggaaaggtccggaaaagagttaatcgtagggaacttcgtggtgggacgggggtccgttccaccatcctccaagagacaacgacccaaaggaccctccgagctaactctacgacaaaatcgaaacngttacgngaaggacgaccggagacgacggtnttaggtttacttacgngacgtggaagtacgaaaggcgtagggggtccgttacggactaacggtcggggaacccagggggtaacccctggtacccaccggtcc

SEQ ID NO: 335173 - DNA, 663 bp, Homo sapiens
  misc_feature: GZ8MTXP02F6LKO.39.37.D04.1.454.CMB.2.raw
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcttggtccaggccggggggtcctgagactctcctgtgcagcctctggacttccccttacgagttattggctgagcgtgggtccnccgaggcctcgaggggaggggttggaggtgggtggaccaacgataaagcaaagatagggaagtcggaaaagngtatcgtaggactgtggtggacgggggtccgttacacctatcctaccgagacgaaaccgaaccgccaaaagtaacccgtcgtagactaactcgtacgactaaaagtcgaaaaccgtagttaccgaggaaggacgacccggaaggacccgtacggtactttaggtttaacttacgacggcggtacggaaagacggaaaacggtcggttacgggggtccgttttaccggacgtaacgggtaccgggggacctaacgggggtaaccctggggtacccaaccgttcccg

SEQ ID NO: 335174 - DNA, 621 bp, Homo sapiens
  misc_feature: GZ8MTXP02JMIM2.39.37.D04.1.454.CMB.2.raw
  modified_base (497)..(497): a, c, t, g, unknown or other
  misc_feature (497)..(497): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccgagggcccggggggtccctgagactctcctgtgcagcctcgtggtacttccccttacgagttattggctgagcgtgggtccgccgaggcctccgaggggtaaggggttggaggtgggtggaccaaacgagtaaagcaaagagtagggaagtaccggaaaagagtatctggacttcgtggtggacgggggtccggttcacctatcctaccgagacgaaccaaacgacccaaagaaccgtccgtagactaatctagacaaaatcgaaacngtcagagacgccgaaggacacggtcttagtttatacgtgacgagagaggaaggtacgtcggggtaccgtttacgacgttaacggtcggggaccgacggggaaccctcgggtaccacccgttccg

SEQ ID NO: 335175 - DNA, 633 bp, Homo sapiens
  misc_feature: GZ8MTXP02GK5XS.39.37.D04.1.454.CMB.2.raw
  modified_base (384)..(384): a, c, t, g, unknown or other
  misc_feature (384)..(384): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaactggggctccgctgggttttccttgttgctattttagaaggtgtccagtgtgaggtgcagctggtggagtcgtgggggagtcctggtcaagccgtgggggtccctgagactctcctgtgcagcctcgtggattcacttcagtagctatagctatgaactgggtcccgcgaggcctcggaggggaaggggcgtggaggtgggtctcgatccattagtcgtagtagtagtacatatacacgcanctacaggtagaaacggggcctaattccaccgtatcctacgagacgaacaacgacaaacgaactccaaacgtgttaaactcctagaacaaaacgtagaaaccgtgaaccgtgacgaacggcccgaaagggaccgtaaacgggtccttaggttacggttaactttaaccgtggttaacgggtaaccgttaaggggttttagggttttttttaccggggtttagggaacgtttcgggtaccctttaaagggg

SEQ ID NO: 335176 - DNA, 587 bp, Homo sapiens
  misc_feature: GZ8MTXP02HSK25.39.37.D04.1.454.CMB.2.raw
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (542)..(542): a, c, t, g, unknown or other
  misc_feature (542)..(542): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccgaggccggggggtccctgagactctcctgtgcagcctctggacttccccttacgagttattggctgagctgggtccgccaggctccgaggggaaggggttggaggtgggtggccaacataaagcaaagagtggaagtccggaaagagtatctggactctggtggagggggtccggttcaccgatctccagagacaacgcaaagaactccgngcatctgacaaatgaacngtcngagagcgaaggtacagggcttagtttatacgtgcgacgagaaggaacggtcgtgggggtccgtttcggaacgtttaacggngggggaccctaacgggggaaccctcggggtacctacccggttccc

SEQ ID NO: 335177 - DNA, 834 bp, Homo sapiens
  misc_feature: GZ8MTXP02GJNVF.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaggtgtcagtgtgcggtgcagttggtggagtcgtgggggaggcttggtccgagggccggggggtccctggagactctccgtgtgcagcctcgtggtacttccccttacgagttatggctgagcgtgggtcccgccgaggcctccggaggggtaaggggttggaggtggggtcggaccaaacgagtaggaggtagagtaggaagagaagaaatactagtggtaggactcgtggtaggaaacggggtccctaagtttccaacctacttaccgtacccgaaaggaacgaaccaaaaccgacccgtaaaagtaactttaccgaaacgtttagttaaaacttttaaacaaaaacgtttacgaaaaccgtaacgtacccgttaggaaacgggaaccggaacccccggaaagggtaacccgtaaaccggtttaccgttaagggtttaaactttaaaccggtttaaacgttttaggggttaaacgggggaaaacccgggggtaaaaaaggggggggtccctaaaagggggtttcggggtaacccgggtttcgggggtaacccgttaaccgggggttacccggggggaacccccgggtaaaaccccggggggttaaacccccccggttaccggtaaaccccccggggttttccctttaaccccccgg

SEQ ID NO: 335178 - DNA, 633 bp, Homo sapiens
  misc_feature: GZ8MTXP02ISONB.39.37.D04.1.454.CMB.2.raw
  modified_base (304)..(304): a, c, t, g, unknown or other
  misc_feature (304)..(304): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccaggccggggggtcctgagactctcctgtgcagcctctggattccccttacgagttattggctgagctgggtccnccaggctcagggagggttgagtggtggcaaacataaaagcaaagatggaagtccggaaaagngtaatctggaactctggngacggggtccgtacactatcacagacgaacaacgacaaaagtaactccgtagacatctacgacaaataagaaacgaagtagtagagacgaccggacggacgacggtacgttacgtttacgtttacgtacgtacggacggaacggaaacggaaacggtaaacggtacggggtaccgggttacggtaacgtaacggtacggggtaccgggtaaccggggtaaacccggtaccggtaccggtacccgtaccg

SEQ ID NO: 335179 - DNA, 721 bp, Homo sapiens
  misc_feature: GZ8MTXP02GRMPY.39.37.D04.1.454.CMB.2.raw
  modified_base (311)..(311): a, c, t, g, unknown or other
  misc_feature (311)..(311): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattgggctgagctgggttttcctgttggtattttagaaggtgtccagtgtgcggtgcagttggtggagtcgtgggggagcttggtccaggcccggggggtcctggagactctcctgtgcagcctcgtggtactttccccgttagagttagttggctgagcgtcgggtccncgaggcctccggaaggggtaaggggttggaggttggggtacggacccaaaacgtaagtaaaaggcaaaaggtacgtaagggaaacggtaccggaaaagtagttaagtcgtaggaccttgtggttacgggacgggggtcccgttacacctatcctacccgaaagacgaaaccaaccgaaccgtaaacgtaacccgttcccgagacctaagttcccagaacctaaaagtacggaaactacggttcagggaacgacgacccggaaaggaccgtaccgggttcttaggtttaaacttccgggaggacgacgggtaaagaaacgggtaaacggtcggttcgggggtacccgtttacgaccgttaacggggcggggacccgtaacggggtaccccctggaacccgtccggttaccc

SEQ ID NO: 335180 - DNA, 391 bp, Homo sapiens
  misc_feature: GZ8MTXP02HVQ9E.39.37.D04.1.454.CMB.2.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (383)..(391): a, c, t, g, unknown or other
  misc_feature (383)..(391): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggcggtttcgactactgggggccaggggaaccctggtcaccgtctcctcagcctcaccaagggcccatcggtcttcccccnggcncccctgcctcccgaggacnccaccnccgagacgcacagccgccctgggctgcctggtacaaaggacctacttccacgtagtcgcgactgacggcgggcctggacaaggcgcatagnnnnnnnnn

SEQ ID NO: 335181 - DNA, 586 bp, Homo sapiens
  misc_feature: GZ8MTXP02GGZAF.39.37.D04.1.454.CMB.2.raw
  modified_base (448)..(448): a, c, t, g, unknown or other
  misc_feature (448)..(448): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccaggccgggggggtccctggagactctcctgtgcagcctctggattccccctttacgagttattggctgagctgggtcccgccaggctccgaggggaaggggttggaggtgggtggaccaacgataaagcaaagatagggagtaccgggaaagagtatcgtggacttcgtggtggagggggccgttcaccgatcctcagacgacaacgccaaagaacctcgngcatctagacaaatgaacagtctagagacgcgagacacggcttagttatacgtcgcgaggagaggaacggcgtggggtcgtttacgacttaacggtcgggggaccacgggggtaacccctgggtaccaccggtttccc

SEQ ID NO: 335182 - DNA, 667 bp, Homo sapiens
  misc_feature: GZ8MTXP02GAF2A.39.37.D04.1.454.CMB.2.raw
  modified_base (577)..(577): a, c, t, g, unknown or other
  misc_feature (577)..(577): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcgttggtccgaggccgggggggtccctggagactctcctgtgcagcctcgtggactttccccttacgagttagttggctggacgtcgtcggggtcccgccgaggcctccggaaggggaaggggttgggaggtggggtcggaccaaacgagtaaaaggcaaagagtagggaagtaccggaaaagagtatcgtaggactcgtggtggacgggggtccgttaccaccgtatccgtaccaaggaacgaaccgaaaccggaccaaaacggtaacctcccggtagaccaagttcgacggactaaaagtgaaacctagttcaggaagacgaccgaggacacggtcttaggtttaactacgngaccgagaagaaggaacggtacgtggggacccgtttagaacgtaacggtcggggaccgtaacgggtacccctggtacccgtaccgttccg

SEQ ID NO: 335183 - DNA, 673 bp, Homo sapiens
  misc_feature: GZ8MTXP02GBHW0.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaggtgtcagtgtgcggtgcagttggtggagtcgtgggggaggcgttggtccgagggccgggggggtcctggagactctcctgtgcagcctctggtacttccccttagagttatggctgagcgtcgggtccgccgaggcctccggaagggggtaagggggttgggaggttgggggtacgggacccaaaacgaagtaaaaggcaaaaggagtagggaagtaccggaaaagagtatcgtggacttcgtggtggacgggggccggctcacatctaccagacgaccaacgaccaaagacctccgtagctaatctagaacaaagtagaaacctagtctagggaacgaacggcccggaaggtaccgaacggtctttaagtttataccgtaggccggtacggaaaggaaacgggaaacgggtaccggttcgggggtacccgttttacgaaccggttacggtacgggggacccgaaacggggtaccccttggggtaccctacccgg

SEQ ID NO: 335184 - DNA, 606 bp, Homo sapiens
  misc_feature: GZ8MTXP02JHKC5.39.37.D04.1.454.CMB.2.raw
  modified_base (285)..(285): a, c, t, g, unknown or other
  misc_feature (285)..(285): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (501)..(501): a, c, t, g, unknown or other
  misc_feature (501)..(501): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcgtgggttttcctgttggtattttagaaggtgtccagtgtgcggtgcagttggtggagtcgtgggggaggcttggtccgaggccggggggtccctggagactctcctgtgcagcctctggattccccttagngttattggctgagcgtgggtaccgccaggcctccgaggggtaaggggttggaggtggggtggaccaacgaagtaaagcaaagagtaggaagtccggaaagagtatcgtggactcgtgtggacggggtccgttcaccgatctcgagagacaacgcaaagactcgtgacatctgacaaatnaaagngttacgagagacgaccggaagtacgaccggtnttagttattacgcgacgagagaacggaacgacggtcggggtacgtttcgaaccgttaacggcggggcccgaacggggtaacccgtcggttaccacccggttcccg

SEQ ID NO: 335185 - DNA, 676 bp, Homo sapiens
  misc_feature: GZ8MTXP02H1VAU.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctgggttttccttgttggtattttagaaggtgtccagtgtgcggtgcagttggtggagtcgtgggggagcttggtccaggccggggggtcctgagactctcctgtgcagcctctggacttccccttagagttattggctgagcgtgggtccgcgaggctaccgaggggaggggttggaggtgggtcggaccaaacgagtaaagcaaagagtaggaagtaccggaaaagagtatcgtaggacttcgtgggtaggaacgggggtcccgttacgaccagtcctaccgagacgaaccaaccgaccaaagaaccttccgtacgactaacgtctagaaccaaaaagttcgaaaaccgtaggttaccgtaaggaacggacggaccccggaaagggaaccgtacggggtctttaaggttttactaacgtcggtaccggacgtaaaggaagtaaacgggtacgtcgggggtaccgtttaccgacgtaacgggtcggggaccgacggggtaaccctgggtaccctaaccggttcccg

SEQ ID NO: 335186 - DNA, 716 bp, Homo sapiens
  misc_feature: GZ8MTXP02I8VS7.39.37.D04.1.454.CMB.2.raw
  modified_base (313)..(313): a, c, t, g, unknown or other
  misc_feature (313)..(313): n is a, c, g, or t
  modified_base (543)..(543): a, c, t, g, unknown or other
  misc_feature (543)..(543): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagtcttgggtccgagggccggggggtccctggacgactctcctgtgcagcctcgtggtacttccccgtttagagttattggctgagcgtgggtccnccaggcctccgaaggggtaaggggttggaggtggggtacggaccaaacgagtaaagcaaaggtataggggaaagtaccgggaaaagtagttagtccgtagggaccttcgtggggtcgggaacgggggtcccgttacaccgattccgtacccgaagtacggaaaccaaacccggccaaaaggtaacccgttccggtgacctactcgtagaacctaaaagttcgaaaaccgngtttcgaggaggaaccggacccgagggacctacgggtctttagtttactaacgtggaccgtagaaggacggaaaagggtccggttacgggggtaccggtttacgaacgttaacgggggttcccggggaaccggtaacgggggtaacccctcggggtaccctacccggtttccg

SEQ ID NO: 335187 - DNA, 641 bp, Homo sapiens
  misc_feature: GZ8MTXP02FI5YD.39.37.D04.1.454.CMB.2.raw
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
  modified_base (542)..(542): a, c, t, g, unknown or other
  misc_feature (542)..(542): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaggtgtccagtgtgcggtgcagttggtggagtcgtgggggaggcgttgggtccgagggcccgggggggtccctggagactctcctgtgcagcctctggacttcccctttacgagttattggctgagcgtgggtccgccaggctccgaggggtaggggttggagtgggtgccaanataaagcaaagntaggaagtcggaaagagtatcgtggactgtggtggacgggggtccggttacacctatcctacccgaagacgaaccaaacgaccctaaaagacccttcccgngctatccgtagaacctaaaatcggaaacngtacgtggaaggacgcccggagaacacgggtcttagtttaactacgnggccgacgaggaagaaacgggtccgttgggggtaccgtttccggaacgttaacggtcgggggacccaacgggggtacccctgggtacccaccgttcccg

SEQ ID NO: 335188 - DNA, 681 bp, Homo sapiens
  misc_feature: GZ8MTXP02JWBC5.39.37.D04.1.454.CMB.2.raw
  modified_base (316)..(316): a, c, t, g, unknown or other
  misc_feature (316)..(316): n is a, c, g, or t
  modified_base (577)..(577): a, c, t, g, unknown or other
  misc_feature (577)..(577): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcttgggttttccttgttggtattttagaaggtgtccagtgtgcggtgcaggttggtggagtcgtgggggaggcgttggtccgagggcccggggggtccctggagactctcctgtgcagcctcgtggactttccccttagagttatggctgagtcgtcggggtcccnccgagggtcctccggaaggggtaaggggttggaggtggggtcggacccaaagaagtaaaagcaaagagtagggtaaagtacccgggaaaagtgttactcgtaggaccttgtggtcgggacgggggtcccgttacaccgtatcctacccgaagaacgaacaaaccggaccaaaaggtaacccgtcccgtagacctacgtactacgaacctaaaagtcggaaaactcgtcgtaggacggaacgcccgaaggaacctccgggtntttacggttttacacgtcgacgacggaagtaggaacggtcgtaggggtccgttacgacgtaacggtcgggggacctacgggtaaccctcggtacccacgttccc

SEQ ID NO: 335189 - DNA, 607 bp, Homo sapiens
  misc_feature: GZ8MTXP02H8H9C.39.37.D04.1.454.CMB.2.raw
  modified_base (291)..(291): a, c, t, g, unknown or other
  misc_feature (291)..(291): n is a, c, g, or t
  modified_base (382)..(382): a, c, t, g, unknown or other
  misc_feature (382)..(382): n is a, c, g, or t
  modified_base (493)..(493): a, c, t, g, unknown or other
  misc_feature (493)..(493): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtgggagtcgtggggggaggcttgggtccagggccggggggtccctggagactctcctgtgcagccctccggattccccctttagngttattggctgagctgggtccgcaggctccgaggggaaggggttggagtggggtggaccaacataaagcaagataggaaagtcggaaaagngtatctgggactcgtgtggagggggtccttcaccatccgccagacgacaacgccaaagacctccgtgcatctgacaaagtgaacagtctagagacgaccgaggacacggtntgtttaataccgtggacgtacggaagaggaacggtacgtgggggtccgtttacgaacgtacggtcgggggtacccaacgggggtacccttgggtccctacccggtttccacccg

SEQ ID NO: 335190 - DNA, 378 bp, Homo sapiens
  misc_feature: GZ8MTXP02FFGQP.39.37.D04.1.454.CMB.2.raw
  modified_base (300)..(300): a, c, t, g, unknown or other
  misc_feature (300)..(300): n is a, c, g, or t
  modified_base (367)..(378): a, c, t, g, unknown or other
  misc_feature (367)..(378): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggactgggcggtttcgactacgtggggccagggaacccctggtcaccgtctcctcagcctccacaagggcccatcggtctcccctggcgcctgctcaggacgcacctccgagagcacagcggccngggctgcctggtcaaggactacttccactagtgcgactgacgcgggcctggccaaggctacataggnnnnnnnnnnnn

SEQ ID NO: 335191 - DNA, 689 bp, Homo sapiens
  misc_feature: GZ8MTXP02HIWTW.39.37.D04.1.454.CMB.2.raw
  modified_base (324)..(324): a, c, t, g, unknown or other
  misc_feature (324)..(324): n is a, c, g, or t
tcagtcgcactagtcacgaccggtgctcgatttagtagcatactgttgggtttggggaggtctcagagaggagccttagccctggactccaaggcctttccacttggtgatcagcactgagcacagagactcaccatggaattggggctgagctgggttttcctgttggtattttagaaggtgtccagtgtgcggtgcagttggtggagtcgtgggggagcttggtccaggccgggggtcctgagactctcctgtgcagcctgtggtacttccccgttagagtttatggctggagcgtggccgcaggctcgagggaggggttgnggtggcgcaacataaagcaaagatagggaagtaccgggaaaagtaggtatcgtaggacttcgtgggttagggacgggggtcccgttccaacctagtccgtacccgaaaggacgaaacccaaacggacccaaaaggtacccgtccggtagaccctaagtcgtacgaactaaagttacgaaacgtacgttacgtaggaacgggaccgaaccgggtagaaccggtaccgttagtttagttttaacgtacgcggtaccggacggtaaggaacggaacggtaccggttacgggggttcccgtttaaccgacgttaaccggggtaccgggaccggtaacccggtaaccccgtggtaccctacccggtcccc

SEQ ID NO: 335192 - DNA, 877 bp, Homo sapiens
  misc_feature: GZ8MTXP02J0CM7.39.37.D04.1.454.CMB.2.raw
  modified_base (326)..(326): a, c, t, g, unknown or other
  misc_feature (326)..(326): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcttgggttttccttgttggtattttagaaggtgtccagtgtgcggtgcagttggtggagtcgtggggggaggtcgttgggtccgagggcccggggggggttcccctggacgtacctcctccgtgtgcacgtcctcgtggtacttcccctttagagttatggctgagcgtgggtccnccgaggcctccgaggggtaggggttggaggtggggtcggcccaaagagtaaaacgcgaaagagtagggaaagtccgggaaaagagtatcgtaggtacctcgtgggtacgggacgggggtcccggttacaacccgtacgttcccgtacccgaaaggaaccgaaaccgaaacccggaaccccaaaacggtaaacccgttccccggtagaccttaaacttccgttacgaaccgtaaaaagttcggaaaaccgtaggttaccgtagggaacggtaaccggacccgggaaacggggtaaccgtaacccgggggttccttttaagggtttttttaaacgttaaaccggtcggggacccgggttaacgggtaaagggggaaacggggtaaaacccggggttccggggtttacgggggggtttacccccgggggtttttaacccggtaaaacccggggttttaacccgggggtacccgggggggaaccccggtaaaaccggggggtttaaaccccccgtttcgggggtaaacccccgtaacccccggggttttcccccg

SEQ ID NO: 335193 - DNA, 360 bp, Homo sapiens
  misc_feature: GZ8MTXP02F1JAF.39.37.D04.1.454.CMB.2.raw
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (347)..(347): a, c, t, g, unknown or other
  misc_feature (347)..(347): n is a, c, g, or t
  modified_base (353)..(360): a, c, t, g, unknown or other
  misc_feature (353)..(360): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggactgggcggtttcgactacgtggggccagggaccctggtcaccgtctcctcagcctccaccaaggcccatcggtctccccnggcncctgctcaggncacctcgagngcacngcggccctgggctgcctggcaaggctcttccatagtgcgactgagcggctggcaaggcncatagnnnnnnnn

SEQ ID NO: 335194 - DNA, 679 bp, Homo sapiens
  misc_feature: GZ8MTXP02FSS04.39.37.D04.1.454.CMB.2.raw
  modified_base (308)..(308): a, c, t, g, unknown or other
  misc_feature (308)..(308): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattgggctgagctggtttcctgttggtatttagagtgtccagtgtgcggtgcagttggtggagtcgtgggggaggcgttggtccgaggcccggggggtccctgagactctcctgtgcagcctcgtggtacttcccctttacgagttattggctgagcgtgggtcccncgaggcctccgaggggaggggttggaggtgggtcggccaaacgagtaaagcaaagagtagggaagtacggaaaagagtatcgtaggaccttctgggtggacgggggtccgttaccacccatccnccgaagagaaccaacgaccaaagaaccctccgancaacgtctacgactaaaagtcgaaacgtacgttcgtaggaaacggacgaccccggaagggacctaacggggtctttagttttaacgtacgtcggacggacggaaaggaagggaaaacgggtacgttcgggggtcccgttttacggaacgttaacgggtccgggggacccgtaaaccgggggtaacccttcggggtacccctaccggtttcccg

SEQ ID NO: 335195 - DNA, 594 bp, Homo sapiens
  misc_feature: GZ8MTXP02H8JQ6.39.37.D04.1.454.CMB.2.raw
  modified_base (521)..(521): a, c, t, g, unknown or other
  misc_feature (521)..(521): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggagcgttggtccgaggccggggggtccctgagactctcctgtgcagcctctggacttccccttacgagttatggctgagcgtgggtccgccgaggcctccgaggggaaggggttggaggtggggtggccaaacgagtaaagctaaagagtaggaagtaccggaaagagtatcgtggactctggtggaggggtcccggttacaccatctaccgagacgacaaccgacctaaagaaccgtcgtcgacactcgtgacaaatgaaacagtactgagagccgagacgacggcttgttatacgtgaccgngagagaaaggcgtacgggtcgtttacgacgtaacggtcggggaccgacggggaaccctcggtcgtacccgtcc

SEQ ID NO: 335196 - DNA, 685 bp, Homo sapiens
  misc_feature: GZ8MTXP02HI9JY.39.37.D04.1.454.CMB.2.raw
  modified_base (503)..(503): a, c, t, g, unknown or other
  misc_feature (503)..(503): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattgggctgagctgggtttctgttggtattttagaggtgtccagtgtgcggtgcagttggtggagtcgtgggggagcgttggtccgagggccggggggtccctggagactctccgtgtgcagtcctcgtggactttccccgttagtagttagttggctgagtcgtcgggtccgccgaggcctccggaggggaaggggttggaggtggggtcggaccaaaacgaataaaacggcgaaaggtataggggaaagtacggaaaagagtatcgtggacttcgtggtcgggagggggtcccgtacacctatctcccgaagtacgaaccaaccgccaaagacctccggtgcatctagaacaaagtgaancgtataggaaggacgaccggagaccgacggtacttaggtttactacgtcggaccgtacggaaaggtaacggtaaacgggtcggttacgggggttaccggttttaccgaaccggttaaccgggtcgggggaaccccgtaaccgggggtaaccccttccgggggtaaccctacccggtttcccg

SEQ ID NO: 335197 - DNA, 757 bp, Homo sapiens
  misc_feature: GZ8MTXP02FGIN8.39.37.D04.1.454.CMB.2.raw
  modified_base (326)..(326): a, c, t, g, unknown or other
  misc_feature (326)..(326): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggttattttagaaggtgtccagtgtgcggtgcagttggtggagtcgtgggggaaggtcgttgggtccgagggcccgggggggttccctggagactctccgtgtgcagcctcgtggtacttccccgttaagagttagttggactgagcgtcgggtccncgaggctccgaggggtaaggggtggaggtgggtcgaccaaagagtaaacgcaaagagtaacgggaaaggtacccggaaaagtacgtaagtcgtagggaaccttcgtggggtacgggaacgggggttccggttaccaaccgtagtaccctaccgaaaggtacgaaaacccaaacccggaaccgaaaacgtaacccgttccggacgacctaaacttccgtagaacctaaaagtacgaaaaccgttggtccgtaaggaacgggaacgcccggaaaagggacccgtaacggggttcctttagttttaaaccgttcgaccgggtacgtaacggggaaaggtaacggaaacgggtcggttacgggggtaccgtttacggacgttaaccggggcgggaccgtacggggtaaccccttgggtcccctaaccggttcccg

SEQ ID NO: 335198 - DNA, 746 bp, Homo sapiens
  misc_feature: GZ8MTXP02G6SLD.39.37.D04.1.454.CMB.2.raw
  modified_base (492)..(492): a, c, t, g, unknown or other
  misc_feature (492)..(492): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggaggtcttgggtccgaggccggggggtccctggagactctcctgtgcagcctctggtacttcccctttacgagtttattggctgagtccgtgggtcccgccaggtcctccggaggggaaggggttggaggtggggtggaccaacgaagtaaacgcaaagagtaggaagtacgaaaagagtatcgtaggactcgtggtgggacgggggtcccggttacacccgtacgtccgtacccgaagaacgaaccaaacgacccgaaagaacccgttccgggtanaccgtagtacctaggaacctaaaagtaccgaaaactcgggtactaggagggaaccgaccggaacggtaaccgaccgggttatttacggttttaaagttacccggtacgggtaccggacgggaaaggtaaacggggaacggggttaccgggtacgggggtttaaccggttacccggtaaccggttaacggggtacccgggggaacccggtaacccgggggtaacccgttccgggtaccccgttaacccgttcccg

SEQ ID NO: 335199 - DNA, 722 bp, Homo sapiens
  misc_feature: GZ8MTXP02FSLA9.39.37.D04.1.454.CMB.2.raw
  modified_base (288)..(288): a, c, t, g, unknown or other
  misc_feature (288)..(288): n is a, c, g, or t
tcagtcgcactagtcacgaccggtgctcgatttagtagcatactgttgggtttggggggagagaggagccttagccctggactccaaggcctttccacttggtgatcagcactgagcacagaggactcaccatggaattggggctgagctgggttttccttgttggtattttagaaggtgtccagtgtgcggtgcaggttggtggagtcgtgggggaggcgttgggtccaggcccgggggggtccctggagactctcctgtgcagcctcgtggtacttccctttacgngttattggctgagtcgtcgggtccgccgaggcctaccgagggggaaggggttgggaggttggggtcggtacccaaacgtaagtaaaagcgaaagtagtagggaaacgtacggaaaagtagtacgtactaggactcgtaggtcgggacggggtcccgttacgacccgtatccgtaccgaagaacgaacccaaaccgggtaccaaaacggtaccctccggtgacctagtacgtagactaaaagtcgaaacctaggtcctagggaacgacgacccgggaagggacctacggtcgtttagtttaacgttcgagtcggacggaaaggacggaaacgggtcgtcgggggttacgtttaccgaccgttacgggtccggggaacccgtaacgggggtaacccccttggggtaccctaccccgtttcgacccgtacgaccccg

SEQ ID NO: 335200 - DNA, 766 bp, Homo sapiens
  misc_feature: GZ8MTXP02F5ZEE.39.37.D04.1.454.CMB.2.raw
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggagcgttggtccgagggcccgggggggtcctggacgactctccgtgtgcacgcctcgtggtactttccccttagagttacttggctgagcgtcgggtcccgcgaggctaccggaggggtaaggggttggaggtggggtacggacccaaacgaagtaaaaggacaaaaggagtaaggggaaacggtaccgggaaaagtagttaactacggtaggacttcgtgggtcgggaacggggggttcccgttaccaacccgtaagttcccgacccgaaaggaacgaaacccgaaaccggaaccgaaaacgtaaacccgtcccggtacgaacgaacttcctacgaactaaaaacgtcgaaaactcggttacaggaacgacggacccggaaggaaccgtacggttactttaggtttaacttacggtacggtcggacggaaaggaacgggtaaaacgggtaccggttgggggttaccggtttaccgtaaccgtaacggggtccggggaacccggtaaacggggtaccccgttcgggttaaccccgacccggtttcccg

SEQ ID NO: 335201 - DNA, 579 bp, Homo sapiens
  misc_feature: GZ8MTXP02H5BKA.39.37.D04.1.454.CMB.2.raw
  modified_base (286)..(286): a, c, t, g, unknown or other
  misc_feature (286)..(286): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (486)..(486): a, c, t, g, unknown or other
  misc_feature (486)..(486): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggaggtcttggtccgaggcccgggggggtcctgagactctcctgtgcagcctctgtacttccccttagngttattggctgagcgtgggtccgccaggctccgagggagggttggagtgggtgccaanataagcaaagatggaagtccggaaaagngtatctggactctggtgacgggggtccgttcacctatctccaagagaccaacgcaaagaacctccgtgacattcgagacaaaatcgaaactgtctagaggacgaccgaggaacncggtacttgtttaatctggcgacgagaggaaaggcgtggggtcgtttcgaactcggtcggggaccacggggtaaccctggtaccctacggtcc

SEQ ID NO: 335202 - DNA, 746 bp, Homo sapiens
  misc_feature: GZ8MTXP02FMQL6.39.37.D04.1.454.CMB.2.raw
  modified_base (311)..(311): a, c, t, g, unknown or other
  misc_feature (311)..(311): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccgaggccgggggggtccctgagactctcctgtgcagcctcgtggacttccccttagagttattggctgagcgtgggtccnccaggctccggaggggaaggggttggaggtggggtggaccaaacagtaaaacgcaaaggagtaggggaaagtaccgggaaaagagtaacgtcgtgggtaactcgttgggtcgggaacgggggtccccgttaccgaaccctaagtccctacccgaaagacgaaacccaaccggacccaaaggtaaacccgttcccggtagacctaacgttccgtacgaaacctaaaagttacggaaaacctacgggttaccgtagggaaacggaaccgggaaccccgaaggggtaaacccgtaccggggtacctttagttttaaacgttaaccggtggtaccggacggtaaaggaaagggaaacgggtcgttacgggggccggttttaccgaacgttaacgggcgggggtaccaacggggtacccttgggaccctaccggttcccg

SEQ ID NO: 335203 - DNA, 645 bp, Homo sapiens
  misc_feature: GZ8MTXP02I1T52.39.37.D04.1.454.CMB.2.raw
  modified_base (349)..(349): a, c, t, g, unknown or other
  misc_feature (349)..(349): n is a, c, g, or t
  modified_base (484)..(484): a, c, t, g, unknown or other
  misc_feature (484)..(484): n is a, c, g, or t
  modified_base (534)..(534): a, c, t, g, unknown or other
  misc_feature (534)..(534): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccgggggggtccctggagactctcctgtgcagcctctggtacttccccttagagttatggctgagcgtgggtccgccaggctccgaggggaggggttggaggtgggtggaccaanagtaaagcaaagagtaggaagtacggaaagagtatcgtaggacttcgtggtggacgggggtcccgttacaccgtatccgtaccagacgaacaacgaccaaagaacctcgtacactatcagacaaaagtcgaaacngttcaggacgacgtcccggaaggaccacgggtctttaggtttaaactcgngaccggtagaagggaagggtaaacggtcggttacggggtaccggttttcgaaaccgtcgggtacgggggacccaacgggggtaaccccctgggtacccgtacccgttcccg

SEQ ID NO: 335204 - DNA, 408 bp, Homo sapiens
  misc_feature: GZ8MTXP02JN05J.39.37.D04.1.454.CMB.2.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (383)..(408): a, c, t, g, unknown or other
  misc_feature (383)..(408): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactggggcggtttcgactacgtggggccagggaacccctggtccaccgtctcctcagcctccacaacgggcccatccggtcctccccnggccnccctgctcccaggacncacctccgagagccacacgccggccctgggctgcctggccaaggctacttccactagtgcgactgacgcggccgtggacaggtccgcgagtagcgnnnnnnnnnnnnnnnnnnnnnnnnnn

SEQ ID NO: 335205 - DNA, 680 bp, Homo sapiens
  misc_feature: GZ8MTXP02FYFDN.39.37.D04.1.454.CMB.2.raw
  modified_base (479)..(479): a, c, t, g, unknown or other
  misc_feature (479)..(479): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctggtttcctgttgtatttagagtgtccagtgtgcggtgcgtagttggtggagtcgtgggggagtcgttggtccgagggcccggggggtccctggacgtactctccgtgtgcacgcctcgtggtactttcccccttaagagtttatggctgacgcgtcgggtcccgccgaggcctcggaaggggtaggggttggaggtgggtcgaccaaacagtaaagcaaagagtaggaagtacgaaagtagtatcgtagactcgtggtgacgggggtccgttacaccgtatccgtacgaagtacgaacgaaccgaccaaagtaacccgtccggngactagtacgaacgaactaaaagtcgaaacgtacgtacgaggaacggaccgacggaacgtacgtacgttatttagttacgtacgcggacggtaaggaaaggtaaaggtaacgggtcggttacggggttaccgttaccggaacgtaaccggggtacgggaacccggtaaccggggtaccgttacggaccccgtaccgttccg

SEQ ID NO: 335206 - DNA, 427 bp, Homo sapiens
  misc_feature: GZ8MTXP02F1DLN.39.37.D04.1.454.CMB.2.raw
  modified_base (272)..(272): a, c, t, g, unknown or other
  misc_feature (272)..(272): n is a, c, g, or t
  modified_base (415)..(427): a, c, t, g, unknown or other
  misc_feature (415)..(427): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttattactgcgcgagagaaggactgggtcggtttcgactacgtggggccagggaacccctggtcaccgtctcctcagcctccaccaagggcccatccggtccttccccctggccnccctgcctccgaggacgccacctccggagacgccacgaggccggcccctggggctcggcctggtacaacggaccttaccgttcccaacgttaggtcgccgaacgtggacggcggggcctgggaccaagggccgacaagtacgnnnnnnnnnnnnn

SEQ ID NO: 335207 - DNA, 741 bp, Homo sapiens
  misc_feature: GZ8MTXP02FHSCY.39.37.D04.1.454.CMB.2.raw
  modified_base (349)..(349): a, c, t, g, unknown or other
  misc_feature (349)..(349): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcttgggttttccttgttggttatttagaaggtgtccagtgtgcggtgctagttggtggagtcgtgggggagtcgttggtccgagggtcccgggggggttccctggacgtacctcctccgttgtcgccacggtccctcgtcggtactttccccccgtttaaggagttagttcggctaggacgtcgtcggggtccccnccgagggcctaccggaaggggtaacggggttggaggtggggtacgaccaaacgagtaaaaggcgaaagagtagggtaacggtaccggaaagtagactcgtacggacctcgttgacgggacgggggtcctacttccaacctaacttccaaccgaaaggacgaaacccaaaccggaccttaaaacggaaccctccgtagccctatacgtacgaactaaaagacgaacctagttccagggacgacgccggtaaggacgtacggcttagttttacacgtcggacgacggaaacggaaggtaaacggtaccggttacggggtccggttttaaccgaacgttacgggtaccgggggaccccgtaacgggtaaccccgtcggtaaccccgttcccccgg

SEQ ID NO: 335208 - DNA, 827 bp, Homo sapiens
  misc_feature: GZ8MTXP02HX4NJ.39.37.D04.1.454.CMB.2.raw
tcagtcgcactagtcacgaccggtgctcgatttagtagcatactgttgggtttgaggtctcagagaggagccttagccctggactccaaggcctttccacttggtgatcagcactgagcacagaggactcaccatggaagttggggctgagcttgggttttccttgttggtattttagaaggtgtccagtgtgcggtgcaggttggtggagttcgtgggggaggcgttggtccgagggccggggggtcctgagactctcctgtgcagcctcgtggacttccccgttagagttatggctgagcgtgggtccgccgaggcctaccggaaggggtaaaggggtttggaaggtcggggtaggaccccaaaagtaaagtaaaagcgaaaagtagtacggggaaagtaaccggggaaaaagaggttaacctcgtagggaccttcgttggtacgggaacgggggtccccggtttacaaccgtaacgttccctacccgaagaaacggaaaccaaaaccggacccctaaaaaggaaacccttccggttacggaccaaagtttccctaggaaaccaaaacttaaacgtaaaacgaacggttacgtaaggaagggaacggacccggaagggaaaccggaaccgggtaccgtttaacggttttaatttaaaaccgtttaggtcccggtaacggtaaacgggaaaacgggtaaaagggaaacccggttacgggggttaccggggttttccgggttaaccggttaaaccggtttaccgggggtaaccgggtaaaccggggaaaaccccggttccggtacccggtaacccggtttacccccg

SEQ ID NO: 335209 - DNA, 700 bp, Homo sapiens
  misc_feature: GZ8MTXP02JXFHW.39.37.D04.1.454.CMB.2.raw
  modified_base (371)..(371): a, c, t, g, unknown or other
  misc_feature (371)..(371): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagcttgggttttccttgttggtattttagaaggtgtccagtgtgcggtgcgtaggttggtggaggtcgtgggggagtcgttgggtccgagggccggggggtcctgagactctctgtgcacgcctgtggtactttcccccgtttagagtttagttggctgagcgtcgggtccgccgaggcctccggaggggtaaggggttggaggtgggtcggacccaaanaagtaaacgacgaaagacgtagggaaacgtaccggaaagagtatcgtaggacttcgtgggtcgggaacgggggtcccgttacaccacgttcctaccgaagacgaaaccaaacggccctaaaggaacccttcgagacctattacgacggaacaaaagtcgaaacgacgttacgagacggaacggccggaacgggaaaccgtcggggtctttaggtttagttaacgcggacggtaacgaggaagggtaacggacggttcgggggtaccgttacggagtaaccgggtaccggggaccgacggggtacccgtacgtaccccgtacggttcccc

SEQ ID NO: 335210 - DNA, 418 bp, Homo sapiens
  misc_feature: GZ8MTXP02GAPTD.39.37.D04.1.454.CMB.2.raw
  modified_base (277)..(277): a, c, t, g, unknown or other
  misc_feature (277)..(277): n is a, c, g, or t
  modified_base (391)..(391): a, c, t, g, unknown or other
  misc_feature (391)..(391): n is a, c, g, or t
  modified_base (411)..(418): a, c, t, g, unknown or other
  misc_feature (411)..(418): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggcttgtttattactgcgcgagagaaggactggggcgtttcgactacgtggggccagggaaccctggtcaccgtctcctcacgccctaccaaccgacgggccctagttccggttcccttcccccgnggccgtcccctgcctccgaggactccacctcgtagacgccaacgcgccggccctgggactcgccgttggacaacggtacctacttcccaagttggtcgcagtgacggcggtccnggaccaagggcctagaatgnnnnnnnn

SEQ ID NO: 335211 - DNA, 669 bp, Homo sapiens
  misc_feature: GZ8MTXP02GII0Q.39.37.D04.1.454.CMB.2.raw
  modified_base (312)..(312): a, c, t, g, unknown or other
  misc_feature (312)..(312): n is a, c, g, or t
tcagtcgcactagtcacgaccggtgctcgatttagtagcatactgttgggtttggggaggtctcagagaggagccttagccctggactccaaggcctttccacttggtgatcagcactgagcacagaggactcaccatggaattggggctgagctgggttttcctgttggtattttagaaggtgtccagtgtgcggtgcagttggtggagtcgtgggggaggcgttggtccgaggccgggggggtccctggagactctcctgtgcagcctctggactttccccttagagttattggctgagcgtgggtcccncgaggctccggaggggtaggggttggaggtgggtgaccaacagtaaagcaaagagtaggaagtacggaaagagtatcgtgactgtggtacggacggggtccgttacacctatcctaccgaagacgaaccaaaccgaccaaaggaacctcccgagaccagtctagaactaaaagtcgaaactgtactaggaacgacggacccgaaggactacgggtctttaggtttaactacgtggaccggtaggaaaggaggaaaacgggtcggtacgggggttaccgtttaccggaaacgtaaccgggttacgggggacccgtaaaccgggggaacccgttgggtaaccccgtaaccggtttcccg

SEQ ID NO: 335212 - DNA, 380 bp, Homo sapiens
  misc_feature: GZ8MTXP02FPM14.39.37.D04.1.454.CMB.2.raw
  modified_base (292)..(292): a, c, t, g, unknown or other
  misc_feature (292)..(292): n is a, c, g, or t
  modified_base (367)..(380): a, c, t, g, unknown or other
  misc_feature (367)..(380): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgagtacacggctgtttattactgcgcgagagaaggactggggcggtttcgactactggtgccaggggaaccctggtcaccgtctcctcagcctccaccaaggcccatcggtcttccccctggccgccctgctccaggagcacctccganagcacagcgccctggctgcctggtcaaggctacttccacgtagtgcgactgagccgggctggcaaggcgcagtgnnnnnnnnnnnnnn

SEQ ID NO: 335213 - DNA, 415 bp, Homo sapiens
  misc_feature: GZ8MTXP02GD0IF.39.37.D04.1.454.CMB.2.raw
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (376)..(415): a, c, t, g, unknown or other
  misc_feature (376)..(415): n is a, c, g, or t
tcagtcgcactagtcacgaccggtgctcgatttagtagcatactgttgggtttgggtgccgaagttgctggaggtcacggttcaccatctccagagacaacgccaagaactccgtgcatctgcaaatgaacagtctgagagccgaggacacggctgtttatactgcgcgagagaaggactgggcggtttcgactacgtggggccagggaacccctggtcaccgtctcctcagcctccaccaagggcccatcggtctcccctggcgccctgctccaggancacctccgagagcacagccggccctggggcngcctggtcaaggctacttcgactagtcgcacgtgaggcgggacctgggacaaagggcgcaagtagnnnnnnnnnnnnnnnnnnnnnnnnnnnnnnnnnnnnnnnn

SEQ ID NO: 335214 - DNA, 575 bp, Homo sapiens
  misc_feature: GZ8MTXP01AOADV.38.33.C11.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (399)..(399): a, c, t, g, unknown or other
  misc_feature (399)..(399): n is a, c, g, or t
tcagtcgatcacgtcacgaccggtgctcgatttagagtgagctcgttgggtttggggaggaactgctcagttaggacccagacggaaccatggaagccccagcgcagcttctcttcctcctgctactctggctcccagataccactggagaaatagttatgacgcagtctccagccaccctgtctgtgtctccaggggaaangccacctctcctgcagggccagtcagagtgttagcgacaacttagcctggtaccagcagaacctggccaggctccaggctcctcatttanggtncatccacgaggccagtggtcgtccccagccaggttcaggtcggcctaggtgggtctggggacagagttcactctcaccatcagcagcctgcagtctgaagttntttcgtcctttattactgtacagacgtaagttaactaactaaccgtcccgtcccccttacgtaccgtttaccgggacggtacgggaaccgtaagggtcggaacgtacgttacgaacgacgtaacgttggcggttcgttacgaacctacctcgttcgtcgttccttcgttcgttccg

SEQ ID NO: 335215 - DNA, 691 bp, Homo sapiens
  misc_feature: GZ8MTXP01ADBAO.38.33.C11.1.454.CMB.2.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccaccctgtctgtgtctccgaggggaaangccaccctctcctgcagggccagtcagagtgttagcgacaacttagcctggtaccagcagaaacctggccaggctccaggctctcatttanggtncatcccaccgaggccacgtggtctcccagcctaggttcaggtcggccctagggtggggtctagggggactaaagggtacgtttccactcctaccaaccctagtcgagccacggtcccctaggaccgtacgggttaccttaagggtaaagtttagtttttacggaccgtttaaaggtttttaattttaaggtttcgttaaccgaaggggtcttaaaggtttacgttagggtaacttaccggttacggttcccgggtaccccgttcccggtaaccttcccgtaaccccggtttcggggaaccccgtaagggggttacccaacgttacgttacggaaacttaaacgttaaaccggacgtggtacggctcggaccttaaccttcttccgtttaacg

SEQ ID NO: 335216 - DNA, 579 bp, Homo sapiens
  misc_feature: GZ8MTXP01CZB9L.38.33.C11.1.454.CMB.2.raw
  modified_base (207)..(207): a, c, t, g, unknown or other
  misc_feature (207)..(207): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (561)..(561): a, c, t, g, unknown or other
  misc_feature (561)..(561): n is a, c, g, or t
tcagtcgatcacgtcacgaccggtgctcgatttagagtgagctcgttggggtttgggggaggaactgctcagttaggacccagacggaaccatggaagccccagcgcagcttctcttcctcctgctactctggctcccagataccactggagaaatagttatgacgcagtctccagccaccctgtctgtgtctccgaagggggaaangcccaccctctcctgcagggccagtcagagtgttagcacaacttgcctggtaccagcaagaaacctggccaggctcccaggctctnatttanggtncanccacgaggcatggtctcccagccaggttcagtggccaggtgggtctgggacaagtattcactctacacatcagcagcctgactagtctagaagttactttgtaccctttattactgtacagactagttaataaactaaccgtcccggtcccccccttcgtaccgtttaccgggacgggtaacggggaccgtaaaggggtggaaacgtacttacgaaacaacggtaaactggttacggcttgaacacctaatcgtnttcctttcgaacttcccg

SEQ ID NO: 335217 - DNA, 530 bp, Homo sapiens
  misc_feature: GZ8MTXP02FOYKE.38.33.C11.1.454.CMB.2.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (456)..(456): a, c, t, g, unknown or other
  misc_feature (456)..(456): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccaccctgtctgtgtctccgaggggaaangccaccctctcctgcagggccagtcagagtgttagcgacaacttagcctggtaccagcagaaacctggccaggctcccaggctccncatttanggtncatccaggaggccacgtggtcgtcccaggccaggttcaggtggcctaggtcggggtctggggacaggagttcactctacaccatcagcagcctgcagtctagagtatttcgaccctttatactgtacagcagtataactaacgtccgtccccctntaccgttcggacggaggaccgaagggtggaagactacacgacgaactgtcgctgcacactctgtctcacttccg

SEQ ID NO: 335218 - DNA, 549 bp, Homo sapiens
  misc_feature: GZ8MTXP02IWTS1.38.33.C11.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccaccctgtctgtgtctccgaggggaangccacctctcctgcagggccagtcagagtgtagcgacaattgcctggtaccagcagaaccngcagctccagctcnattnggtncatccagnggcacgtggtcnccagccagtnagtggcnggtggctagggacagtagttcactcacacntcagcagctgctgtctagtagttatttcgtaccctttattacttgtactagtacgtaagttaactaaacgttaccgtacccgtacccccttacgtaccgtttcgggacggtaacgggacgtaagggtcggaacggactacgaacgaacgtacgtggtacgtccgtacgccacgtactctcgtcttctactttcccg

SEQ ID NO: 335219 - DNA, 559 bp, Homo sapiens
  misc_feature: GZ8MTXP02HA0KM.38.33.C11.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgatactctgactcccagaaatcactggagaaatcgtgatgacgcagtctccagccaccctgtctgtgtctccaggggganagagcccaccctctcctgcagggccagtcagagtgttagaacacctagcctggtaccatcagaaacctggccaggctcccagactccncatctatgatgcatccaccgagggcccacgtggtcctccagccgtaggttcccaggtggctaggtcgggtctggggacagtcgttcacgtctacactntcagcacgtcctgcagtctagaaacgttntttagacttagtttattattgtacagtactagtatagtattcgaggttcgcctacgacgttcctaccggttcggaccgaagggacctacggaacgtacggaaactaaacgtaaacgtacgtcggtacggctacgacctaacg

SEQ ID NO: 335220 - DNA, 661 bp, Homo sapiens
  misc_feature: GZ8MTXP02H3432.38.33.C11.1.454.CMB.2.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccaccctgtctgtgtctccgaggggaaancgccaccctctcctgcagggccagtcagagtgtagcgacaattagcctggtaccagcaagaacctggccaggcctccaggctctcatttanggtncatcccacggaggcccagttggtagccaaaggcccaagggttcaggttggccaggtgggtctggggaacaggtattcgacttctccaacctatcaagccacgccncgacagtctagtaagttacttttcgtacccttttattacttgtacctagtactaagttaattaaacttaaccgtcccgtaccccccttaccgtaccggttttccgggaccgggtaacgggtaacccggtaaaggggttacgggaacggtaacgttacgaaaccgtaaccggtaaaccgtttaggaccgggtcgttacggaaccgtaaccccgtaatttacccggttacgtttccctttaccttaaccgtttcccccg

SEQ ID NO: 335221 - DNA, 614 bp, Homo sapiens
  misc_feature: GZ8MTXP02F3Y6G.38.33.C11.1.454.CMB.2.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccacctgtctgtgtctccgaggggaaanacgccaccctctcctgcagggccagtcagagtgttagcgacaacttagcctggtaccagcagaaacctggccaggcctcccgaggcctcctntatttagnggtncatccgaaggcggccacgtggtctcccagcctaggttcaggtcggccgtaggtcggggtctaggggacaggtacgttcaactctacaccatcgagccacgcctacgcgtacgtcgtagtaagttacgttttcgtaccttttattacgtcgtactagtactaagtaactaacttaaccgtcccgtaccccctacgtaccgtttcgggaccggtacgggaaccgtagggtacggacgtacgtacgaacgtacgtaaacgtcggtcgcgtacgaaccaccgtacttcgttcgttcttacctactttcccg

SEQ ID NO: 335222 - DNA, 586 bp, Homo sapiens
  misc_feature: GZ8MTXP02IS3EX.38.33.C11.1.454.CMB.2.raw
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (378)..(378): a, c, t, g, unknown or other
  misc_feature (378)..(378): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccaccctgtctgtgtctccgaaggggaaancgccaccctctcctgcagggccagtcagagtgtagcgacacttgcctggaccagcagaactggcagcnccngctctnattngtncatccagcggccagtggtctcccagccctaggttcaggtcggccgtaggtcggggtctaggggaacaggtacgttcactctaccacctntacgagcacgcctgcagtcgtagtaagttactttcgtacctttattacgtgttctagtactaagttactaacttaaccgtcccgtccccccttacgtaccgttcgggaccggtacgggaaccgtaagggtaggtaacgtactacgaacgaacgtacgtacggtacgtcgtacgaaccgacctactcttcgtacctttctactttcccg

SEQ ID NO: 335223 - DNA, 622 bp, Homo sapiens
  misc_feature: GZ8MTXP02F8D8Q.38.33.C11.1.454.CMB.2.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
tcagtcgatcacgtcacgaccggtgctcgatttagagtgagctcgttgggtttgggggaggaactgctcagttaggacccagacggaaccatggaagccccagcgcagcttctcttcctcctgctactctggctcccagataccactggagaaatagttatgacgcagtctccagccaccctgtctgtgtctccgaggggaaangccacctctcctgcagggccagtcagagtgttagcgactaacttagcctaggtaccagacagaacctggccaggcctcccgaggctcctctatttagnggtncactccgacgacggccctagtcggtcgtcccaggcccgtaggttcaggtggccgtaggtgggtctggggacaggtacgttcaccttctaccgaccatcgacgacgacgtcctcgcgtacgtcgtagtaaacgttcttttccgtacccttttattaccgttgtaccgtagtacctagttaataaacttaccgtacccgtcccccctgtaccgttcgggacggtacggaaccgaggtacgacgtacgtacgaacgtaccgtaagttcgtacggcctacggaacctacgtacgtccttacgttcttactactttccccg

SEQ ID NO: 335224 - DNA, 494 bp, Homo sapiens
  misc_feature: GZ8MTXP01EO259.22.57.F02.1.454.CMB.2.raw
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
tcagacatacgcgtcacgaccggtgctcgatttagctcgatatagttgggtttgggagtcagacccagtcaggacacagcatggacatgagggtcccgctcagctcctggggctcctgctgctctggctcccaggtgccaagtgtgacatccagatgacccagtctccttcaccctggctgcatctgtaggagacagagtcaccatcacttgcggccagtcagatataatagtgtgctggtatcagcagaaaccagggaaagcccctatactcctgatccacaaggcgtctactttagaaagtggggtccatcaaggttcagccggnactggatctgggacngaattcactctcaccatcaacagctgcagcctgatgattggtcacttactaactcgcaacgtactagtacttattcgtcaccttcgtccaacggacgacgaactggagattaaacgtaactagttgcttgnaccaatcttnttcttcttctc

SEQ ID NO: 335225 - DNA, 584 bp, Homo sapiens
  misc_feature: GZ8MTXP01D0YV7.22.57.F02.1.454.CMB.2.raw
  modified_base (348)..(348): a, c, t, g, unknown or other
  misc_feature (348)..(348): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcggccagtcagaatattaatgtggtgctggtatcagcaagaaaccagggaaacgcccctatactctgatccacaaggcgtactacttagaaagtgggtccatcaaggttcagccggcaatggatcgtagggacngaattcactctacacatcaacagcctgcagcctagatgatttggactaacttactactcggacctaaaccgttatacgttacttagttccggtactaccgttcggaccgaaagggaccaacggtaacttagggaacgtaaacgtttaaaaccggaaacgttggttaacgggccttacggaacctaaaaccccgttaacgttaccgttcgttaccctttaaccgttaaccgttcccg

SEQ ID NO: 335226 - DNA, 504 bp, Homo sapiens
  misc_feature: GZ8MTXP01AT1IA.22.57.F02.1.454.CMB.2.raw
  modified_base (196)..(196): a, c, t, g, unknown or other
  misc_feature (196)..(196): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (477)..(477): a, c, t, g, unknown or other
  misc_feature (477)..(477): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcgggccagtcagaatattaatagttggtgcctggtatcagcagaaaccagggaaagcccctatactcctgatccacaaggctctactttagaaagtgggtccatcaagttcagccgcatgatcgtagggacngaattcactctcacatcaacngcctgcagcctagatgatttggctaacttactactggaccaaccgtatacgtacttattcggtctaccttcggccaagggtcacgaactggagaattaaacgaactgnggcttgcacaatctgttctcaattccc

SEQ ID NO: 335227 - DNA, 532 bp, Homo sapiens
  misc_feature: GZ8MTXP01DUAEG.22.57.F02.1.454.CMB.2.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (382)..(382): a, c, t, g, unknown or other
  misc_feature (382)..(382): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcgggccagtcagaatattaatgttggtgctggtatcagcagaaaccaggaaacgcccctatactccngatccanagcgtactactttagaaagtgggtccatcaaggttcagccggcactggatcgtagggacaagtaattcaactctacacatacaacagccagcancctagatgatttggactaacttactactagggaccctaaacgtattacgtaactttaattccgggttacaacccgtttcggaccaaagggcaacgaactaggaagtaattaaacgactgttaggcttacgcaccaatctnttctcnctcc

SEQ ID NO: 335228 - DNA, 530 bp, Homo sapiens
  misc_feature: GZ8MTXP01AQJEQ.22.57.F02.1.454.CMB.2.raw
  modified_base (347)..(347): a, c, t, g, unknown or other
  misc_feature (347)..(347): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatgttggtgcctggtatcagcagaaaccagggaaagcccctatactcctgatccacaagcgtctactttagaaagtgggtccatcaaggttcagccggcatggatctagggacngaattcactctcacatcaacagcctgcagcctgatgatttggactaacttactactggacctaacgttatacgttacttagttcggtctaccttcggccaagggtcacgtaactggaagtaacttaaacggaaactggttaggcttggaaccacgtaactcgtcgttccttcgaactttcccc

SEQ ID NO: 335229 - DNA, 524 bp, Homo sapiens
  misc_feature: GZ8MTXP01BNCIM.22.57.F02.1.454.CMB.2.raw
  modified_base (247)..(247): a, c, t, g, unknown or other
  misc_feature (247)..(247): n is a, c, g, or t
  modified_base (347)..(347): a, c, t, g, unknown or other
  misc_feature (347)..(347): n is a, c, g, or t
  modified_base (510)..(510): a, c, t, g, unknown or other
  misc_feature (510)..(510): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagatattaatgttgtgctggtatnagcagaaaccagggaaacgcccctatactcctgactccacaaggcgtactactttagaaagtgggtccatcaagtcagccggcacgtgatcgtagggacngaatcactctcacatcaacagcctgcagcctgatgtatttggactaacttactacttcgacctaaccgtatacgttacttacgttcgtactaaccttcggacctaagggacacggaactggagtaacttaaacgaacgtgttggcttggcacctaatccgttnttcttcttcgtccg

SEQ ID NO: 335230 - DNA, 533 bp, Homo sapiens
  misc_feature: GZ8MTXP01ESBN2.22.57.F02.1.454.CMB.2.raw
  modified_base (351)..(351): a, c, t, g, unknown or other
  misc_feature (351)..(351): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggtggctggtatcagcagaaaccagggaaagcccctatactcctgatccacaaggcgtactactttagaaagtgggtccatcaagtcagccggcactggatcgtagggacngaattcactctcacatcaacagcctgcagcctagatgatttggactaacttactactggacctaaacgtatagtacttattcggtacaccttcggaccaagggcacggaatcggaagaacgttaaacgaacttggttacggcttaggaaccacctaattctagttcttcgttaacgttcccg

SEQ ID NO: 335231 - DNA, 507 bp, Homo sapiens
  misc_feature: GZ8MTXP01DOI9I.22.57.F02.1.454.CMB.2.raw
  modified_base (349)..(349): a, c, t, g, unknown or other
  misc_feature (349)..(349): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggcagtcagaatattaatagtggtgctggtatcagcagaaaccaggaaagcccctatactctgatccacaaggcgtactactttagaaagtgggggtcccatcaaggttcagcggcaatggatctagggacngaaattcaactctacaccatcaacagcctgcagcctagatgatttggactaacttactactaggcctaaaccgtatagtacttattcggtcaccttcgaccaaggcacgaactggagtaattaaacgaatgnggcttgcacaatcngttctcncttcc

SEQ ID NO: 335232 - DNA, 505 bp, Homo sapiens
  misc_feature: GZ8MTXP01AGKDB.22.57.F02.1.454.CMB.2.raw
  modified_base (355)..(355): a, c, t, g, unknown or other
  misc_feature (355)..(355): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggttggcctggtatcagcagaaaccagggaaagcccctatactcctgatccacaaggcgtctactttagaaagtggggtccatcaaggttcagccggcactggatcgtagggacngaattcactctcacatcaacagcctgcagcctgatgatttggcaacttactactggcctaaccgtatagtacttattcggtcacttcgccaagggcagaactggagattaaacgaactgttggcttgcaccaatctgttcttcaattccc

SEQ ID NO: 335233 - DNA, 592 bp, Homo sapiens
  misc_feature: GZ8MTXP01DVFF9.22.57.F02.1.454.CMB.2.raw
  modified_base (270)..(270): a, c, t, g, unknown or other
  misc_feature (270)..(270): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgaggagacagagtcaccatcacttggcggccagtcagaatattaatagttggtgctggtatcagcaagaaacagggaaacncccctatactcctagactaccaacgaaggccgttacttaacgtttaaggaaaaggttcggggtacccagttacgaaaggttcagccggacaaatggatcgtaagggacaagtaacttcactctacacatacaacagcctgcagcctagatgtattggactaaacttactacgtcggaccctaaaccgtaattaacgttacttacgttccggtacctaacccgtttcggaccgaaacgggacaacgtaacgtaggaaagtaaattaaacgacgtgttacggcttcggaaccacctaattctcttccttcgttaacgttccccg

SEQ ID NO: 335234 - DNA, 574 bp, Homo sapiens
  misc_feature: GZ8MTXP01EL7U2.22.57.F02.1.454.CMB.2.raw
  modified_base (276)..(276): a, c, t, g, unknown or other
  misc_feature (276)..(276): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagacatacgcgtcacgaccggtgctcgatttagctcgatatagttgggtttgggggagtcagacccagtcaggacacagcatggacatggacgggtccccgctcagctccgtggggctcctgctgctctggcctccaggtgccaagtgtgacatccagatcgacccagtctccttccacctggctgcatctggtaggagacagagtcaccatcacgttggcggcagtcaagaatattaatgttggtgctggtatcagcaagaaacagggaaacncccctatactcctagactccaacgaaggtctacttaacgttaaggaaacggtcgggtaccatacgaaggttcaggccgcagtggatcgtagggaacaagtaattcacttctacaccataccaanacgtccngcacgtcctagacttgtagttcgactaactttacactacggaaccctaaacgttatacgttacttagtccggtacaccgtcgaccgaaggacacggaataggaaagtaaacgttaaacgatggttacggcttacgaacctacaattctgttcttcgttaacttcccg

SEQ ID NO: 335235 - DNA, 555 bp, Homo sapiens
  misc_feature: GZ8MTXP01CON93.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctccttccacctggctgcatctgtaggagacagagtcaccatcacttgcgggcagtcagaatattaatagttggtggctggtatcagcaagaaaccaagggaaacgcccctaatactcctgactccaacaaggctactaacgtttaagaaagtcgggggtaccatcaaaggttcagccggcacgtggatcgtagggaacaaggaaacttcactctacaccatacaaacagcctgcagcctagatgattggactaacttactactggaccaaacgtatacgtactattcggtacaccgttcggaccaagggacaacgaactggaaagtaacttaaacgaaactggttcggcttggaaccaccaattcgtgttccttccaactttccccg

SEQ ID NO: 335236 - DNA, 533 bp, Homo sapiens
  misc_feature: GZ8MTXP01CDWEO.22.57.F02.1.454.CMB.2.raw
  modified_base (249)..(249): a, c, t, g, unknown or other
  misc_feature (249)..(249): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (455)..(455): a, c, t, g, unknown or other
  misc_feature (455)..(455): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagatataatgtggtgctggtatnagcagaaaccagggaagcccctatactctgatccacaaggctctactttagaaagtgggtccatcaaggttcaggccggcacgtggatcgtagggacngaaattcactctacaccatacaacngcctgcagctgatgatttggactaacttactactggacctaaacgtatagttacttattcgtcaccgttcgacctaagggacncgaacgtaggaagtaaacttaaacgaacgttggttacggcttacgccacctaattctgttccttcgttaactttcccg

SEQ ID NO: 335237 - DNA, 517 bp, Homo sapiens
  misc_feature: GZ8MTXP01EXG32.22.57.F02.1.454.CMB.2.raw
  modified_base (285)..(285): a, c, t, g, unknown or other
  misc_feature (285)..(285): n is a, c, g, or t
  modified_base (350)..(350): a, c, t, g, unknown or other
  misc_feature (350)..(350): n is a, c, g, or t
  modified_base (487)..(487): a, c, t, g, unknown or other
  misc_feature (487)..(487): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatataatagtgtgctggtatcagcagaaacaggaaagcccctatactcctgatccanaaggcgtactactttagaaagtggggtcccatcaaggttcagccggcacgtggatcgtagggacngaaattcactctacacatcaacagcctgcagcctgatgatttggcaacttatactggacctaaacgtattaagtacttattcggtctaaccgttcggaccaaagggacacgaaccttaggagaattaaaacgactgnggcttgcaccaatctgttcttcaattcccg

SEQ ID NO: 335238 - DNA, 552 bp, Homo sapiens
  misc_feature: GZ8MTXP01BLPMT.22.57.F02.1.454.CMB.2.raw
  modified_base (345)..(345): a, c, t, g, unknown or other
  misc_feature (345)..(345): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggcagtcagaatattaatgtgtgctggtatcagcagaaacaggaacgccctatactctagatccacaaggctactactttagaaagtggggtccatcaaggttcagccggcactggatcgtagggacngtaatcactctacacatacaacagcctgcagcctagatgattggactaacttactactggacctaacgtatacgtacttattcgtactaccgttcggacctaagggaccacggaacgtgggaaacgtaaacgttaaacgaaacgttggttacgggttcttcggaaccacccgtaattcccgttaggttccttcgttaacgtttcccg

SEQ ID NO: 335239 - DNA, 526 bp, Homo sapiens
  misc_feature: GZ8MTXP01DR6VO.22.57.F02.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
  modified_base (402)..(402): a, c, t, g, unknown or other
  misc_feature (402)..(402): n is a, c, g, or t
  modified_base (508)..(508): a, c, t, g, unknown or other
  misc_feature (508)..(508): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccacctggctgcatctgtaggagacagatcaccatcacttgcggccagtcagaatataatagtgtgctgntcagcagaaaccaggaaacnccctanactccngatccanaagcgtactacttagaaagtcgggtaccatcaaggttcagccggcatggatcgtaagggacnggaaattcactctacaccatcaacagcctgcagcctagatgattgactaactactacncggtacaacgtaatacgtattactcgtctaccgttcggaccgaaggaccagaacttaggaagtaattaaaccgaaacgttgacggttcaggccaacgtaactcgtnttctttcaacgtttcccc

SEQ ID NO: 335240 - DNA, 521 bp, Homo sapiens
  misc_feature: GZ8MTXP01BIFLR.22.57.F02.1.454.CMB.2.raw
  modified_base (196)..(196): a, c, t, g, unknown or other
  misc_feature (196)..(196): n is a, c, g, or t
  modified_base (245)..(246): a, c, t, g, unknown or other
  misc_feature (245)..(246): n is a, c, g, or t
  modified_base (262)..(262): a, c, t, g, unknown or other
  misc_feature (262)..(262): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagatcaccatcacttgtcggcagtcagaatattatgtgtgctggtannagcagaaccaggaacncccctatactcctgactccacaaggctactactttagaaagtcgggtccatcaaggttcacgccggcaatggatccgtagggactgaaattcactctcacatcaacagccctgcagcctgatgtactttggactaacttactaactcggacctaacgttatacgttacttacttcggtacaccgttcgaccaagggcaacgaagtagganaattaaacgacgtgttcggnttcgaacacaatctgttctcaactttccc

SEQ ID NO: 335241 - DNA, 538 bp, Homo sapiens
  misc_feature: GZ8MTXP01CVHKH.22.57.F02.1.454.CMB.2.raw
  modified_base (357)..(357): a, c, t, g, unknown or other
  misc_feature (357)..(357): n is a, c, g, or t
  modified_base (521)..(521): a, c, t, g, unknown or other
  misc_feature (521)..(521): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatgttggtggctggtatcagcagaaaccagggaaacgcccctatactcctgatccacaaggcgtactactttagaaagtgggggtcccatcaaggttcagccggcactggatcgtagggacngaattcactctcacatcaacagcctgcagccctagactgtatttggactaacttactactggtaccctaaaccgttattaacgtactttagttccggtactaccgttcggacctaagggaccacgaacgtaggagtaattaaacgaaacgtgttagcttgcacntctgttcttcaattccc

SEQ ID NO: 335242 - DNA, 583 bp, Homo sapiens
  misc_feature: GZ8MTXP01BZSLN.22.57.F02.1.454.CMB.2.raw
  modified_base (241)..(243): a, c, t, g, unknown or other
  misc_feature (241)..(243): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcaatatatatgtgtgctgnnnanaacgaacgaggaaccncctatactcagactccaagacggtcttacttaacgttaaggaaagggttccggtacctagtacgtaaggtcgacggcccgactacgtggactcggaagggacaagtactccactctacacatacaacgctccagcacgctagtatagttacgttacgaaccttaaacttactaaccgtcggaaacccttaaacgttataacgttacttcgtccgactaccggtccgaacgaaggccagtaacgtagaacgttaaacttaaacggtacgtgggacgttcacgaaacctaacgttgttctcttacctttaacgccctttccccg

SEQ ID NO: 335243 - DNA, 553 bp, Homo sapiens
  misc_feature: GZ8MTXP01EQQIH.22.57.F02.1.454.CMB.2.raw
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatataatagtggtgctgtatcagcagaaacaggaaacncccctatactcngactcacagctactactttagaaagtgggtccatcaaggttcagccgacaagtggatcgtagggacngaaattcactctcacatacaacngtcctgcagcctagattgtactttaggacctaaacttactactacggtaccctaaacggttattacgtactttaagtccgtactaccgttcgaccgaaaggtacacgaactaggaagtaagttaaacgaacgttggttaggcttacggcctactaattcgtcgttacctttcgttaacgttttcccc

SEQ ID NO: 335244 - DNA, 578 bp, Homo sapiens
  misc_feature: GZ8MTXP01EP2HT.22.57.F02.1.454.CMB.2.raw
  modified_base (251)..(251): a, c, t, g, unknown or other
  misc_feature (251)..(251): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatagttggtgctggtatnagcaagaaaccaggaaacgcccctatactcctgactccaacgaaggcgtactactttaggaaagttcggggtaccagtccaaaggttcagcccggacaagtgatcgtagggacaagaattcactctcacatacaacagcctgcagctagatgatttgactaacttactactacggacctaaacgttatacgttaccttagttccgtactaccgttcggacctaaagggaccaagaacgtggaagtaaacgttaaaacggaacgttggacgggttcttacggtaacccaacgtaacttcgtacgttcctttccgttaacgtttccccg

SEQ ID NO: 335245 - DNA, 561 bp, Homo sapiens
  misc_feature: GZ8MTXP01C8PLB.22.57.F02.1.454.CMB.2.raw
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcggcagtcagaatattaatagtggtgctggtatcagacagaaacagggaaagcccctatactcctgatccacaaggcgtatacttagaaagtgggtaccatcaaaggttcagccggacacgtggatcgtagggacaagaatcaactctacacatcaacngcctgcagcngattgatttggactaacttactactacggacctaaacgttattaacgttactttaagttccggttactacccgttcggtacccgaaaggggaccacgaacgttggggaaactaaacgttaaacgtaaacgtggttcggcttcgaacacctaattcctgttcttcgttaacgttccccg

SEQ ID NO: 335246 - DNA, 541 bp, Homo sapiens
  misc_feature: GZ8MTXP01CGHZP.22.57.F02.1.454.CMB.2.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagatattaatgttgtgctgtatnagnagaaaccaggaagcccctatactcctgatccacaaggctactactttagaagtgggtccatcaaggttcagccggcagtggatcgtagggacaagaattcactctcaccatcaacagcctgcagcctagatgatttgactaacttactactcggactaaccgtataacgtactttagtcggtacctaccgttcggaccgaaggtaccacgtaacgtaggaagtaacttaaacggaacgttggttcggcttacgaaccaccgtaatcttgttccttcgaacgtttccccg

SEQ ID NO: 335247 - DNA, 520 bp, Homo sapiens
  misc_feature: GZ8MTXP01BP0O8.22.57.F02.1.454.CMB.2.raw
  modified_base (354)..(354): a, c, t, g, unknown or other
  misc_feature (354)..(354): n is a, c, g, or t
  modified_base (490)..(490): a, c, t, g, unknown or other
  misc_feature (490)..(490): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatgtggttggctggtatcagcagaaaccagggaaagcccctatactcctgatccacaaggcgtactactttagaaagtggggtccatcaaggttcagccggcaatggatcgtagggacngaattcactctcacatcaacagcctgcagcctgatgatttggctaacttactactggacctaaaccgttatacgttacttattccggtcaccttcggacctaagggcacggaactggaagtaattaaacgaactgnggcttgcacctaatctgttcttcaattccc

SEQ ID NO: 335248 - DNA, 531 bp, Homo sapiens
  misc_feature: GZ8MTXP01C8MW4.22.57.F02.1.454.CMB.2.raw
  modified_base (352)..(352): a, c, t, g, unknown or other
  misc_feature (352)..(352): n is a, c, g, or t
  modified_base (512)..(512): a, c, t, g, unknown or other
  misc_feature (512)..(512): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcacatcacttgtcggcagtcagatattaatagttggtgctggtatcagcagaaaccagggaaacgcccctatactcctgatccacaaggcgttctactttagaaagtggggtcccatcaaggttcagccggacaatggatcgtagggacngaaattcactctacacatcaacagcctgcagcctgatgatttggactaacttactactaggaccctaaacgttatacgtacttagttcggtactaccgttcgaccgtaagggacaacgaacgtggaagtaattaaacgtaacgtgttggcttggcacctntctgttccttcaagttccc

SEQ ID NO: 335249 - DNA, 561 bp, Homo sapiens
  misc_feature: GZ8MTXP01BIPL1.22.57.F02.1.454.CMB.2.raw
  modified_base (387)..(387): a, c, t, g, unknown or other
  misc_feature (387)..(387): n is a, c, g, or t
  modified_base (547)..(547): a, c, t, g, unknown or other
  misc_feature (547)..(547): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcgggcagtcagaatattaatgtggtgctggtatcagcagaaacagggaaacgcccctatactctgactccacaaggcgtactaacgtttagaaagtcggggtacccagtaccgaaaggttcaagtcccggcacgtggatcgtagggacaagaattcactctacacatacaacngacctgcagctagatagtattcggactaacttactacgtcggaacctaacgttaattaacgttacttaacgttcggaccttaaccgtcggaaccgaaaggtaccaacggtaactaggaagtaacttaaacgaacgtggacgcttgaacctactaatcgtnttctcaacttcccg

SEQ ID NO: 335250 - DNA, 524 bp, Homo sapiens
  misc_feature: GZ8MTXP01D6RKJ.22.57.F02.1.454.CMB.2.raw
  modified_base (441)..(441): a, c, t, g, unknown or other
  misc_feature (441)..(441): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcattgcggccagtcagatattatgtgtgctggtatcagcagaaaccagggaaacgcccctaatactcctgactccaacaaggccgttactaactttaggaaagttcgggggtcccaatcaaaggttcagcccggcaaagtggatcgtaagggacaagaattcactctacacatcaacagctgcagcctagatgattggacaacttactactggacctaacgtatagtacttntcgtctaccttcggcctaagggacacggaactggaatagttaaacgactggttgcttgcnccaatcgtnttcttcttaatccc

SEQ ID NO: 335251 - DNA, 644 bp, Homo sapiens
  misc_feature: GZ8MTXP01AX4SH.22.57.F02.1.454.CMB.2.raw
  modified_base (270)..(270): a, c, t, g, unknown or other
  misc_feature (270)..(270): n is a, c, g, or t
tcagacatacgcgtcacgaccggtgctcgatttagctcgatatagttgggtttggggagtcagacccagtcaggacacagcatggacatgagggtccccgctcagctcctggggctcctgcttctctggctcccaggtgccaagtgtgacatccagatgacccagtcctccttccacctggctgcatctgtaggagacagagtcaccatcacttgtcggcagtcagaatattaatagttggtgctggtatcagcaagaacgagggaaacncccctaatacctcctgactccaacgaaggcgtactaacgtttaggaaacggttcggggtacccaagtcgtaaggttcagcggaccaaagtggatcgtagggaaacagtaacttcactctacacatacaaacacgcctagacacgcctagaactgtatttcggaataaacttactactacgacctaaacgttattaacgttactttaacgttccggtacctaccgttcggaaccgtaaacggggacctaacggtaccgtaaggggtaaacgttaaacgtttaaaaccggacgttgggttacgggaccttacggacccttaaacccgtacgtttcgttaccgtttaccttaccttaaccgtttcccgttaaccccg

SEQ ID NO: 335252 - DNA, 576 bp, Homo sapiens
  misc_feature: GZ8MTXP01B5JCA.22.57.F02.1.454.CMB.2.raw
  modified_base (194)..(194): a, c, t, g, unknown or other
  misc_feature (194)..(194): n is a, c, g, or t
  modified_base (264)..(264): a, c, t, g, unknown or other
  misc_feature (264)..(264): n is a, c, g, or t
tcagacatacgcgtcacgaccggtgctcgatttagctcgatatagttgggtttggggagtcagacccagtcaggacaaagcatggacatgagggtccccgctcagctcctggggctcctgctgctctggctcccaggtgccaagtgtgacatccagatcgaccagtctccttcacctggctgcatctgtagganacagatcacatcacttgcggcagtcagtaattattaatgttggtgctggtatcagcaagaacgaggaacnccctatactctagactaccagaaggctactaacgttaggaacggtcgggtacccatacgaagttcagcgacagtggactcgtaggaacagtaacttcactctaccaacatacaacgacgtcctagacagcctagtactgtacttcggaccttaacgttactacgtacgacctaaacgttattaacgtacttcgtccggtcctacgttccgacgtaacggacacgtacgaaggtaacttaaattaaaccggagtcggtcggcttacggacccaaccgtattccgtattccttactaaccttccgttaaccccg

SEQ ID NO: 335253 - DNA, 560 bp, Homo sapiens
  misc_feature: GZ8MTXP01ATAO3.22.57.F02.1.454.CMB.2.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatataatagttggtgctggtatcagcagaaaccagggaacncccctatactctgatccanaaggcgtactacgtttagaaagtgggtcccatcaaggttcaggccgacaagtggatcgtaagggacaagtatcactctacacatacaacagcctgcagctagatgatttggactaacttactactcggacctaacgtatacgttaacttgttccggtactaccgttcggaccgtaaagggaccacggtaacgtagggaaagtaaacgtttaaacgaaacgttggttacgggcttcgaacctaccaacgttctcgttccttcgttaacgttcccg

SEQ ID NO: 335254 - DNA, 590 bp, Homo sapiens
  misc_feature: GZ8MTXP01CONT8.22.57.F02.1.454.CMB.2.raw
  modified_base (196)..(196): a, c, t, g, unknown or other
  misc_feature (196)..(196): n is a, c, g, or t
  modified_base (247)..(248): a, c, t, g, unknown or other
  misc_feature (247)..(248): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (390)..(390): a, c, t, g, unknown or other
  misc_feature (390)..(390): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcggccagtcaagtattatatgtggtgctgtnnananaagaacgaggaaccncctatctctgactaccagagtcttactaacgttaagaagggttcgggaccagtacgtaacggtcacggccgactacgtggtactcggtaagggacaagtactcactctaccactataccaacncgcctgacacgtctagtacgtgttagtttcgaacttaacttactacctacggtaacccttaaaccgttattaaccgttactttacgttcgtaccttaccgtcggaaccggaaggaccacgtaaggtaggaataaacgttaacgtaacgtggacgttacttcgaaccacgtaattccttgttccttaacgttctttccccg

SEQ ID NO: 335255 - DNA, 532 bp, Homo sapiens
  misc_feature: GZ8MTXP01B4DG5.22.57.F02.1.454.CMB.2.raw
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaacgcccctatactcctgatccacaaggcgtctactttagaaagtggggtccatcaaggttcagccggcacgtggatcgtgggacngaattcactctcaccatcaacagcctgcancctgatgtatttggactaacttactactcggacctaaaccgttataacgttacttagttcggtctaccgttcggaccgtaagggaccacgaactggagtaattaaacgaactgttcgggcttgcacaatctgttcttcaacttcc

SEQ ID NO: 335256 - DNA, 583 bp, Homo sapiens
  misc_feature: GZ8MTXP01BDHXX.22.57.F02.1.454.CMB.2.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggcagtcagaatattaatagttggtgctggtatcagcaagaaacagggaaacgcccctatactcctagactccacaacggtctacttaactttaaggaaaggtcggggtaccagtcgtaaaggttcacggccggcacgtggactcgtagggaacngtaacttcactctacacatacaacagcctgcagctagatgtactttgactaacttacacttcgggacctaacgtatacgttactcgttccggtctaccgttcggtaccgaagggtacacggtaacgtagggaaagtaaacgtttaaacggacgttggttacgggttccttcggtaaccactaacttcttgttcctttcgttaactttccccg

SEQ ID NO: 335257 - DNA, 493 bp, Homo sapiens
  misc_feature: GZ8MTXP01D5IEA.22.57.F02.1.454.CMB.2.raw
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (345)..(345): a, c, t, g, unknown or other
  misc_feature (345)..(345): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgcggcagtcagaatataatgtgtgctggatnancagaaaccaggaaagcccctatactcctgatccaacaaggcgtactactttagaaagttggggtccatcaaggttcagcggcaatggatcgtagggacngaatcactctcacatcaacagcctgcagctgatgatttgacaacttactactgacctaacgtatagtacttatcggtcaccttggcaaggcngaactggataattaaacgaactggngcttgcaccaatctgttacttcaagtttccc

SEQ ID NO: 335258 - DNA, 553 bp, Homo sapiens
  misc_feature: GZ8MTXP01EBI4U.22.57.F02.1.454.CMB.2.raw
  modified_base (196)..(196): a, c, t, g, unknown or other
  misc_feature (196)..(196): n is a, c, g, or t
  modified_base (267)..(267): a, c, t, g, unknown or other
  misc_feature (267)..(267): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagatcacatcacttgcggcagtcagaatattaatagttggttgctggtatcagcagaaaccagggaaancccctatactcctagactcccagaaggcgtactacgtttaggaaagttcggggtacccattcgaaaggttcaggccggacaaatgggatcgtagggacaagaattcactctacacatcaacacgcctgacagcctagattagtatttgacctaacttactactacgacctaacgtatacgtacttagttcgtctaccgttcggaccaagggtacacggtaaccgaattaacttaaaacgacgtgtaggcttgaccaacctatctcgtcttctaacttcctaacccg

SEQ ID NO: 335259 - DNA, 532 bp, Homo sapiens
  misc_feature: GZ8MTXP01BX38D.22.57.F02.1.454.CMB.2.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (353)..(353): a, c, t, g, unknown or other
  misc_feature (353)..(353): n is a, c, g, or t
  modified_base (526)..(526): a, c, t, g, unknown or other
  misc_feature (526)..(526): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggcggcagtcagaatattatgttggtgctggatnagcagaacagggaancccctatactcctgactccacaaggctactactttaggaaacgttggggtacccatcaaggttcagccggacaagtggatcgtagggacngaattcactctcacatacaacagcctgcagctagatcgtatttggactaacttactacgtacggaccctaaacgttattaacgttacttacgttcggtctaccgttcggaccgtaagggacacgaacgtggaactattaaacgatgttggcttcgctacaattctgttcttcnttcccc

SEQ ID NO: 335260 - DNA, 521 bp, Homo sapiens
  misc_feature: GZ8MTXP01EAR01.22.57.F02.1.454.CMB.2.raw
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatattaatgttggtgctggtatnagcagaaacagggaagcccctatactcctgatccacgaaggcgtactactttagaaagttggggtccatcaaggttcagccgcactggatcgtagggacngtaattcacctctcacatcaacagcctgcagcctagatgtattggactaacttactactggacctaacgtattagtacttntcggtcacttcggccaagggtcngaactggaacgtaattaaacgaacgtgacggttcttacgctacaacttctgttcttcaactttcccg

SEQ ID NO: 335261 - DNA, 557 bp, Homo sapiens
  misc_feature: GZ8MTXP01D3WE7.22.57.F02.1.454.CMB.2.raw
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttggcggcagtcaagaattattaatagttggtggctggtatcagcaagaaccgaagggaacncccctatactcagactccaagaaggtcgtacttaacgtttaagaaaggttcgggtacccagtacgtaaaggttcaagcccggacacgtggatcgtaagggaacaagtaacttccaactctacgaacataccgaacagcctgacacgtcctagatgtattcgactaacttacgtactcggaaccctaacgtattacgtacttacgtcggcctaaccgtcgacgtaaaggcacgaatagacgtaattaaacgatggttcgcttagcaactntctnttctcnctcc

SEQ ID NO: 335262 - DNA, 551 bp, Homo sapiens
  misc_feature: GZ8MTXP01AIT74.22.57.F02.1.454.CMB.2.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggttggctggtatcagcaagaaaccagggaaacgcccctatactctgactccacaaggctactactttagaaagtcgggtaccatacaaggttcagccggcacgtggatcgtagggacaagaactcactctcacatacacagcctgcagctagatgatttggactaacttactactggacctaacgttataacgttacttagttccggtactaccgttcggaccgaaagggacctaacggaactagggaacgtaaacgtttaaacgaacgttggttaggcttagccacctctcgtcttcttcgttcgtcc

SEQ ID NO: 335263 - DNA, 531 bp, Homo sapiens
  misc_feature: GZ8MTXP01CM7RA.22.57.F02.1.454.CMB.2.raw
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (511)..(511): a, c, t, g, unknown or other
  misc_feature (511)..(511): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggcagtcagaatattaatgttggtgctggtatcagcagaaacaggaacncccctatactcctgactccanaaggcgttactacgtttagaaaggttcggggtacccattacgaaaggttcaggcccggacacgtggactcgtaagggacaagaacttcactctacaccatacaacacgcctgcagctgatgtattgactaactactactcgacctaacgtatagtacttatcgtctaccgtcgacaaggcagctggataacttaaacgactggttcggcttacgcaaccgttntctcgttcctcttccgtccg

SEQ ID NO: 335264 - DNA, 562 bp, Homo sapiens
  misc_feature: GZ8MTXP01CGIO7.22.57.F02.1.454.CMB.2.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (398)..(398): a, c, t, g, unknown or other
  misc_feature (398)..(398): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggccagtcagatattaatgtggtgctggtatnagcagaaacaggaacnccctanactcctgatccagaaggtctactactttagaaagttcggggtacccatacgaaagggttcaaggtccccggataaagtggggaatccgtaaggggaactaagaaatttcaactctacaccatcaaacngacctgacagcctagactgtatttggactaacttactactggacctaacgtatacgtactttactcggtccaccttcggaccgaaggaccaacggaactaggaagtaacttaaacgaaacgtgcggttcttcgaacacctaatcctattcttcgaactttcccg

SEQ ID NO: 335265 - DNA, 572 bp, Homo sapiens
  misc_feature: GZ8MTXP01BQ3CY.22.57.F02.1.454.CMB.2.raw
  modified_base (196)..(196): a, c, t, g, unknown or other
  misc_feature (196)..(196): n is a, c, g, or t
  modified_base (250)..(251): a, c, t, g, unknown or other
  misc_feature (250)..(251): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccacctggctgcatctgtagganacagagtcaccatcacttggcggccagtcagaatattaatagtggtgctggtannagcagaacaggaacncccctatactcngactccagaggtctactacgtttagaagtcgggtaccatacaaggtcagccggcacgtggatcgtaagggacngactcactctcacatacanagcctncancctagatgtattggactaacgttactactacgggtaccctaaacggttattaacgtacttaacgttccggtactacccgttcgacgtaaacgggcaacgggaactagggaaagtaacgtttaaacggaacgttgggttacggttcttcggaacctaccgtaacttccgttggttacctttcgaactttccccg

SEQ ID NO: 335266 - DNA, 570 bp, Homo sapiens
  misc_feature: GZ8MTXP01BPYFH.22.57.F02.1.454.CMB.2.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (352)..(352): a, c, t, g, unknown or other
  misc_feature (352)..(352): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggcagtcagatattaatgtgtgctggtatcagnagaacaggaagcccctatactcctgatccacaaggcgtctactttagaaaggtggggtacccagtacaaggttcagtcccggcacgtggatcgtaagggacnggtaattcactctacacatcaacagcctgcagcctgatgatttggactaacttactactggacctaacgtatagtacttacgtcggtactaccgttcggaccgaaagggtaccacggtaacgtagggaagtaaacgtttaaaacgaacgttcggttacgggccttacggaacctaacccgtaagttaccgtcgttacctttccttaaccgtttccccg

SEQ ID NO: 335267 - DNA, 597 bp, Homo sapiens
  misc_feature: GZ8MTXP01AR793.22.57.F02.1.454.CMB.2.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (390)..(390): a, c, t, g, unknown or other
  misc_feature (390)..(390): n is a, c, g, or t
tcagacatacgcgtcacgaccggtgctcgatttagctcgatatagttggggtttgggggagtcagacccagtcaggacacagcatggacatgagggtccccgctcagctcctggggctcctgcttctctggctcccaggtgccaagtgtgacatccagatgacccagtcctccttccacctggctgcatctgtaggagacagagtcacatcacgttgtcgggcagtcaagtatattatagttggtgctgtatcancagaacgaggaacnccctatactctgactccacgaggcgtacttaacgtttaggaaaggtcgggggtacccagtacgtaaggttcaggcgacaagtggatcgtaggaaacagtaatcactctacaccatacaacncgcctgcagcctgtactgtatttcggactaacttactactacgaacctaacgttattaacgttacttagttccgtacctaccgttccggaaccgtaacgggtaccaacggacgtaacgggtaagttaaacgttaaacgttacgttgggtacggacgttcggacctaacctagttcgttctccttactaaccgtttcccgtaaccccg

SEQ ID NO: 335268 - DNA, 559 bp, Homo sapiens
  misc_feature: GZ8MTXP01ECB6P.22.57.F02.1.454.CMB.2.raw
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgcggcagtcagaatatatgtggtgctgtatcagcagaaaccaggaaacnccctatactctgactccanaggcgttactaacgtttaggaaaggttcgggtacccagtacgtaaaggttcaagccgaacaagtggactcgtaagggaactaagtaacttcactctaccaacatacaacncgtcctgacagcctagacttgtattgactaaacttactacngacctaacgtattacgtacttagtccgtctaaccgtcggacaagggcaacgtaacgtggaaagtaaacgttaaacgacgtaggttcggcttacggaacacctaagtctgttccttcaactttccccg

SEQ ID NO: 335269 - DNA, 562 bp, Homo sapiens
  misc_feature: GZ8MTXP01CP4AG.22.57.F02.1.454.CMB.2.raw
  modified_base (250)..(250): a, c, t, g, unknown or other
  misc_feature (250)..(250): n is a, c, g, or t
  modified_base (252)..(253): a, c, t, g, unknown or other
  misc_feature (252)..(253): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (370)..(370): a, c, t, g, unknown or other
  misc_feature (370)..(370): n is a, c, g, or t
  modified_base (375)..(376): a, c, t, g, unknown or other
  misc_feature (375)..(376): n is a, c, g, or t
  modified_base (412)..(412): a, c, t, g, unknown or other
  misc_feature (412)..(412): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
tcagacatacgcgtcacgaccggtgctcgatttagctcgatatagttggggtttggggagtcagacccagtcaggacacagcatggacatgagggtccccgctcagctcctggggctcctgctgctctggctcccaggtgccaagtgtgacatccagatgacccagtctcccttccaccctggctgcatctggtaggagacagagtcaccatcacttgtcggcagtcagatattaatgttggtgctgatnannagaacaggaacnccctatactcngactccanaggtctataacgttagaaaggtcgggtaccatacgaaggttcagcccggacaagtggatcgtagggacaagtaatcactcacacanacacnncctgcagctagatgtattgactaacgttactaccgngtaccctaaacgttaattacgttaactttacgttccggtacctaccgttaccgggaaccaaggggtaccaacggtaacgtaggaaacgtaaattaaacgtaaacgtgttagcttgaaccacgtntacgtnttaccttcttaacttccccg

SEQ ID NO: 335270 - DNA, 776 bp, Homo sapiens
  misc_feature: GZ8MTXP01C2A5T.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgcggcagtcagaatattaatagttggtggctggtatcagcaagaaaccgagggaaacgcccctaatactcctagactccaacgaacggtccgttacttaaacgtttaaggaaaacggttcgggggtacccctaagttacgaaaggttcaaggtccccggactacgtggaacttccgtaaggggaactaaggtaaactttccaaaccttacctaccaaccctaactacccaaacacggtccctaggcctaaacgtcccgtaggtaacttaggtaacgttttacgggaaaccttaaaaccgtttaaccttaacccgttaacgggtaacccccgttaaaaaccggtttaacgtttaaaccggtttaaaccgtttttaaccgtttaccccggggtttaccttaaaccccgggttttaccggggaaaccccggaaaacgggggtaaccctaaaccgggtaaccgttaaggggaaacgttaaacgttaaaaccggtacgtacgggtttacgggccttacggtaaccctaacgtaacgttcttcggttaccttcgttaacctttcccccg

SEQ ID NO: 335271 - DNA, 680 bp, Homo sapiens
  misc_feature: GZ8MTXP01CNUZU.22.57.F02.1.454.CMB.2.raw
  modified_base (247)..(247): a, c, t, g, unknown or other
  misc_feature (247)..(247): n is a, c, g, or t
  modified_base (651)..(651): a, c, t, g, unknown or other
  misc_feature (651)..(651): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgtcggcagtcaatattatagtgttggtgctgtancagacaacgaacgaaggaacctccctatactcagactaccaagacggtctacttaacgttaagaagggttcggacctagtacgtaaggttcgacggcccgactacggtaggtactcgggtaaacgggaactaagttaacttacctaccttaccaacccaaccttacaaaccaaaccgtcgtacccgagacacgtccgtaagtagttagttacgttacggaaccttaaacgtttactaccgtacggtaaccccgttaaacgtttaagttaaccgtttaccgttttacgtacccgttaccgtacccgggttaccggtaaaccggaacggacccgtaacggtaaccggtaagggttaaacgttaaacgttaaaccggtagtggttacggttcttacgaactaacttntcgttacttccttcgttaacctttccccg

SEQ ID NO: 335272 - DNA, 542 bp, Homo sapiens
  misc_feature: GZ8MTXP01BZM8I.22.57.F02.1.454.CMB.2.raw
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctcccttccaccctggctgcatctgtaggagacagagtcaccatcacttgcggcagtcagaatattaatgttggtgctggtatcagcagaaaccagggaacgcccctatactcctgactccacaaggcgtactacgtttagaaggtcgggtccatcaaggttcagccggnagtgatcgtagggacngaatccactctcacatacaacagcctgcacgcctagatgtattgctaacttacactcgggtacctaacgttatacgttaactttagttcgtacctaccgttcggaccgtaacggacacgaacgtaaggagtaagttaaacgactggttacggcttaggccacgtaactcttacgttcttcaacttccccg

SEQ ID NO: 335273 - DNA, 523 bp, Homo sapiens
  misc_feature: GZ8MTXP01BGE3P.22.57.F02.1.454.CMB.2.raw
  modified_base (517)..(517): a, c, t, g, unknown or other
  misc_feature (517)..(517): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggcagtcagaatattaatgttggtggctggtatcagcagaaaccagggaaacgcccctatactctgactccacaaggctctactttagaaagtgggtccatcaaggttcagccggcacgtggatcgtagggacaagattcactctcacatcaacagcctgcagcctgactgtatttcggactaacgttactacgtagacctaacgtatagttacttacgttccgtctaccgttcggcctaagggacacggaactgggaatattaaacgacgtgttggcttcgcacctaatctgttcttcncttccc

SEQ ID NO: 335274 - DNA, 533 bp, Homo sapiens
  misc_feature: GZ8MTXP01ECSPT.22.57.F02.1.454.CMB.2.raw
  modified_base (196)..(196): a, c, t, g, unknown or other
  misc_feature (196)..(196): n is a, c, g, or t
  modified_base (365)..(365): a, c, t, g, unknown or other
  misc_feature (365)..(365): n is a, c, g, or t
  modified_base (441)..(441): a, c, t, g, unknown or other
  misc_feature (441)..(441): n is a, c, g, or t
  modified_base (526)..(526): a, c, t, g, unknown or other
  misc_feature (526)..(526): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggcagtcagaatattaatagtggtgctgtatcagcagaaaccaggaaacgcccctaatactcctgactccacaaggcgttactaacgttttaagaaacgttgggggtacccatcgaaggttcagtccggacaagtggatcgtagggacngattcactctacacatcaacagctgcagctagatgattgactaacttactactcgacctaacgtattacgtacttnttcggtcaccttcggacctaagggacagaacttggagtaaacgtttaaacgacgtgttacggcttgccacgaatctcgttcttcncttcccg

SEQ ID NO: 335275 - DNA, 540 bp, Homo sapiens
  misc_feature: GZ8MTXP01AVWIQ.22.57.F02.1.454.CMB.2.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (364)..(364): a, c, t, g, unknown or other
  misc_feature (364)..(364): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatcgaccagtctccttccaccctggctgcatctgagganacagatcaccatcacttgcggcagtcagtaatatatgttggtgctggtatnagacagaaaccaggaacnccctatactctgactccacagctactacgttagaagtcggtccatcgaaggtcagccgacaagtggatcgtagggacaagtatcactctacacatcaacngcctgcacgtctagatgtacttggactaactactacgtacgacctaaacgttatacgttacttacgtccggtctaaccgttcggaccgaagggtaccacggtaagtacggaagtaacttaaacgtacgtggttcgttcttacgaacactaactcgtcttacttcgaacgttccccg

SEQ ID NO: 335276 - DNA, 610 bp, Homo sapiens
  misc_feature: GZ8MTXP01AJRXX.22.57.F02.1.454.CMB.2.raw
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
tcagacatacgcgtcacgaccggtgctcgatttagctcgatatagttgggtttggggagtcagacccagtcaggacacagcatggatatgagggtccccgctcagctcctggggctcctgctgctctggctcccaggtgccaagtgtgacatccagatgacccagtctccttccaccctggctgcatctgtaggagacagagtcaccatcacttggtcgggccagtcaagtaatattaatagttggtggctggancagacagaaaccaggaaacncccctatactctgactccaacaaggtcgttactaacgttttaaggaaacggttcggggtaccccaattaccgaaaggttcaagccggacaaagtggactcgtaagggaacaagtaacttcactctacaccataccaaactacgcctagcaacgtcctaggattagtagtttacggactaactttaactaccgtacgggtaaccctaaaccggttattaacggttactttacgttccggtacctaaccggttcgaccgaaagggacacgaagtcggaagtaacttaaacggaactggttggcttacggccactnttcngttaccttcgcttccccg

SEQ ID NO: 335277 - DNA, 600 bp, Homo sapiens
  misc_feature: GZ8MTXP01B0007.22.57.F02.1.454.CMB.2.raw
  modified_base (197)..(197): a, c, t, g, unknown or other
  misc_feature (197)..(197): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttggcggcagtcagaatattaatgtgtgctgtatnagnagaaacgaggaacnccctatactcctagactaccaacaacggtctacttacgtttaaggaaacggttcggggtacccagttacgaacggttcaacggtccggactacgtggtactcggtaagggaactaaggtaacttccactcctacaaccatacaactacgcctgacacggcctagaatgtagtttgactaacttactacgtacggacctaaacgttattaacgttactttacgttccggtactacccgttcggaccgtaaacggggaccacggtaactaggaagtaacttaaacgacgtggttaggcttacgaacctactaattcgtcttcttcgaacgtttcccg

SEQ ID NO: 335278 - DNA, 541 bp, Homo sapiens
  misc_feature: GZ8MTXP01AZF38.22.57.F02.1.454.CMB.2.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (359)..(359): a, c, t, g, unknown or other
  misc_feature (359)..(359): n is a, c, g, or t
  modified_base (380)..(381): a, c, t, g, unknown or other
  misc_feature (380)..(381): n is a, c, g, or t
  modified_base (386)..(386): a, c, t, g, unknown or other
  misc_feature (386)..(386): n is a, c, g, or t
  modified_base (534)..(534): a, c, t, g, unknown or other
  misc_feature (534)..(534): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcggcagtcagtaatattaatagttggttgctggtatcagcaagaaccagggaaacnccctatactctgactccaacgaggcgtacttacgtttagaacggtgggtaccatcgaaggttcagccgcacgtggatcgaagggacngaattcactcacacatcaacnnctgcngctgatgattcggactaacgttactacgtacggtactaaacgtatacgttactttagtcggtactaccgttcggaccgaagggacacgtaacgaggttaaatacttaaacgaagtgttcgacttgaaccaccgtaatcgtattcttcncttcccc

SEQ ID NO: 335279 - DNA, 572 bp, Homo sapiens
  misc_feature: GZ8MTXP01D0ODC.22.57.F02.1.454.CMB.2.raw
  modified_base (274)..(274): a, c, t, g, unknown or other
  misc_feature (274)..(274): n is a, c, g, or t
  modified_base (393)..(393): a, c, t, g, unknown or other
  misc_feature (393)..(393): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcaagaatattaatagttggttgctggatcagcagaaaccagggaaacncccctatactcctagatccacaaggcgtacttaactttaaggaaacgttggggtacccattacgaaggttcaggccgcacgtggatcgtagggacaagtatcactctacacatacaacngctgcagcctagatgtatttaggactaacttactactacgacctaacgttattaacgtacttacgtcggtacctaaccgttcggaccgtaaggaccagaacgtaggaagtaattaaacgtaacgttggttaggttcttcgaacctaacctaattctcgttacctttccaacgtttcccc

SEQ ID NO: 335280 - DNA, 560 bp, Homo sapiens
  misc_feature: GZ8MTXP01AR4UA.22.57.F02.1.454.CMB.2.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcgggccagtcagaatattaatagtgtgctgtatnagcagaaacagggaaacncccctatactctgactccacaggctactacttaggaaagtcgggtaccagtcaaggttcagccggacacgtggatcgtagggacaagtatcactctcaccatcaacagcctgcagcctagactgtatttcggactaacttactactcgggtacctaaaccggttatacgttacttagtccggtactaccgttccggacgtaacgggaccacgaacgtggaagtaacgtttaaacgacgttgggttacggcttacggcctacgtaattccctgttactcgttaactttccccg

SEQ ID NO: 335281 - DNA, 557 bp, Homo sapiens
  misc_feature: GZ8MTXP01AMJT6.22.57.F02.1.454.CMB.2.raw
  modified_base (505)..(505): a, c, t, g, unknown or other
  misc_feature (505)..(505): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatgttggtgctggtatcagcagaaaccgagggaaacgcccctatactcctgactaccacgaaggcgtactaacgtttaggaaaggttcgggggtacccagttacgaaagggttcaaggtcccggacacgtggatcgtagggacaagtattcactctacacatacaacagcctgcagcctgatgattgactaacttactactcgggacaaacgttatagttacttcgttcggtacctaccgttcggaccaacgggctaacgaacgtgggaanacgttaaagacgtagttcggcttcgctacctaatctgttctcgaactttccc

SEQ ID NO: 335282 - DNA, 649 bp, Homo sapiens
  misc_feature: GZ8MTXP01ETFZW.22.57.F02.1.454.CMB.2.raw
  modified_base (196)..(196): a, c, t, g, unknown or other
  misc_feature (196)..(196): n is a, c, g, or t
  modified_base (268)..(268): a, c, t, g, unknown or other
  misc_feature (268)..(268): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagatcaccatcacttgcggcagtcagaatataatagtggtgctggtatcagcaagaaaccgagggaaacncccctaatactctagactccaagaaggtcttacttacgtttaaggaaacggttcggggtaccagtacgtaaaggttcacggccggactacgtgggactcggtaagggaactaaggtacttccacttctacaccatacaacngcctgcacncctagattagtagtttacgactaacgttactaccgtacggtaacccttaaacgttattaacgtttaaccgtttacgttaccggttacctaacccgtttacggggaacccgtaaacgggaccgtaacggtaaccggttaggaaacgttaaacgttaaacccggaagttggttacggttccttacggccctaaccgtaacgtttccgtcgttaccttcttaaccgtttccccg

SEQ ID NO: 335283 - DNA, 527 bp, Homo sapiens
  misc_feature: GZ8MTXP01CIYPH.22.57.F02.1.454.CMB.2.raw
  modified_base (248)..(249): a, c, t, g, unknown or other
  misc_feature (248)..(249): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (350)..(350): a, c, t, g, unknown or other
  misc_feature (350)..(350): n is a, c, g, or t
  modified_base (508)..(508): a, c, t, g, unknown or other
  misc_feature (508)..(508): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctcctttcaccctggctgcatctgtaggagacagagtcaccatcacttgtcggccagtcagaatataatgtgtgctggtannagcagaaacagggaacncccctatactcctgactccanaaggctactactttagaaagtgggtcccatcaaggttcagccggcacgtggatcgtagggacngaattcacttctcacatcaacagcctgcacgcctagactgtacttgactaacgttactactcggacctaaccgtattacgtaacttcttcggtcctaccgttcgacctaagggcacggaactgggaatattaaacgaactggttcggcttcgcacctntctagttctcttcttcccg

SEQ ID NO: 335284 - DNA, 621 bp, Homo sapiens
  misc_feature: GZ8MTXP01DFNC1.22.57.F02.1.454.CMB.2.raw
  modified_base (250)..(250): a, c, t, g, unknown or other
  misc_feature (250)..(250): n is a, c, g, or t
  modified_base (391)..(391): a, c, t, g, unknown or other
  misc_feature (391)..(391): n is a, c, g, or t
  modified_base (598)..(598): a, c, t, g, unknown or other
  misc_feature (598)..(598): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatgtggtgctgtatnagacagaaacaggaaacgcccctatactctgactccacaagtcgtactaactttaaggaaaggttcggggtacccagtacgtaaggtcaggccggacaagtggatcgtaagggacaagtaatcactcacacatacaactancctagactacgccgtagtactgtacgtttacggactaaaccttactaacgtacgggtaccctaaacgttaactaaacgtttacttaacgttccggtaccttaacccgttcggaacccgtaaagggacccaacggtaaccgtaggaaaggtaaactttaaaaccggaacgttggttacggcgttacgaacctaaccctaagttccctnttaccttcccttaagtttccccg

SEQ ID NO: 335285 - DNA, 549 bp, Homo sapiens
  misc_feature: GZ8MTXP01A2EDO.22.57.F02.1.454.CMB.2.raw
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgtcgggccagtcagaatattaatagttggttggcctggtatcagacagaaaccaggaaacgcccctanactcngatccanaaggctactactttagaaaggtggggtaccatcaaggttcaggtccganaaagtggatcgtagggaacaagaattcactctcacatcaancgcctgcagcctgatgtattcggactaacgttactactcggaaccctaacgttatacgttacttattcggtacctacgttcgaccgtaaggaccacgaatcggaagtaacttaaacgaacgtgttacggcttcgaacacctaatactgttacttcgaacgttcccc

SEQ ID NO: 335286 - DNA, 578 bp, Homo sapiens
  misc_feature: GZ8MTXP01DBNKM.22.57.F02.1.454.CMB.2.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtcctcccttccaccctggctgcatctgtaggagacagagtccacatcacttggtcggcagtcagatattatagttggtgctggtatnagnagaaacagggaacnccctatctctgatccacaggctactacttagaaggtcgggccatcaaggtcagccggcacgtggatcgagggacaagaacttcactctaccacatacaacacgcctagccagtcctagtactgtacgtttggacttaacttacttacgtacggtaaccctaaccgtttaattacgttactttacgttccggtaccgttaacccgttccggtaaccgaaacgggacctacggaacgtggaaagtaacgttaaacgtaacgtggttacggcttcgaacctactcttcgtcttacttcgttctttccccg

SEQ ID NO: 335287 - DNA, 529 bp, Homo sapiens
  misc_feature: GZ8MTXP01DHF9Z.22.57.F02.1.454.CMB.2.raw
  modified_base (198)..(198): a, c, t, g, unknown or other
  misc_feature (198)..(198): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (508)..(508): a, c, t, g, unknown or other
  misc_feature (508)..(508): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctcccttccaccctggctgcatctgtagganacagagtcacatcacttgcggcagtcagatatatagtggtgctgtancagcagaaacagggaaacncccctatactctgactccanaggctactactttagaagtcgggccagtacaaggtcagccgcacgtggatcgtagggaacaagaattccactctacacatacaactagcctgcagctagatgtatttcgactaacgttactactcgggacctaacgttatacgttattcgtcggtctaccgtcggaccaaggcaggtaactggaataacgttaaacgaacgttggcggttcttacgctaccttntctcgttcttcgttcgttccc

SEQ ID NO: 335288 - DNA, 636 bp, Homo sapiens
  misc_feature: GZ8MTXP01DGQ7D.22.57.F02.1.454.CMB.2.raw
  modified_base (244)..(245): a, c, t, g, unknown or other
  misc_feature (244)..(245): n is a, c, g, or t
  modified_base (247)..(248): a, c, t, g, unknown or other
  misc_feature (247)..(248): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctcccttccaccctggctgcatcgtggtaggagacagacgtcacatcacttgcggcagcagaatatatagtgtgctgnnannagaacaggaacnccctatctcngactccagacgtctactagttagaagggtcggtccatcgaaggtcagtccggacacgtggactcgtaagggaactaaggacttccgaacctcctaccacctataccaacgtagcctaggcctagccgttaagatttacgtagtttcggaccttaaacgtttctaaccgtcggtaacctaaaccggtttattacggttacctttaagttccggtaccttaccggttaccgggaccgtaaaggggaccaacgggtaacgtagggttaaacgttaaacgttaaaaccggtacgttcgggttaacggttcttaaccgtaaccctaccgttaagtttcccgtgtttccctttaacgttccctttaaccccg

SEQ ID NO: 335289 - DNA, 527 bp, Homo sapiens
  misc_feature: GZ8MTXP01BGID7.22.57.F02.1.454.CMB.2.raw
  modified_base (242)..(243): a, c, t, g, unknown or other
  misc_feature (242)..(243): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (410)..(410): a, c, t, g, unknown or other
  misc_feature (410)..(410): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatatatgtgtgctgnnagnagaacaggaacnccctatctcngatccanaaggctatacttagaagtcgggtccatcgaaggttcagccggcacgtggatcgtagggacaagtaaactcactctcacatacaacagcctagcagcctgatgatttggactaacttactactggaccaaacgttntaacgttacttacgttcgtctaccttcggaccctaaagggacacggaactagggaataacgttaaacgtaactggttcggacttggaacctactaatcgtgttcttcaacgttcccc

SEQ ID NO: 335290 - DNA, 623 bp, Homo sapiens
  misc_feature: GZ8MTXP01BUDHM.22.57.F02.1.454.CMB.2.raw
  modified_base (424)..(424): a, c, t, g, unknown or other
  misc_feature (424)..(424): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatgttggtggcctggtatcagcaagaaaccgagggaaacgcccctatacctcctgactccacgaaggtcgttactaacgtttagaaaggttcgggggtaccccagttaccgaaggtttcacggccggacctacgtgggactcgtaggggaacctaaggtaactttccacttcctacaccataccaacngacctgcagtcctagattgtatttggactaacttactaccgtacgaccctaaccgttattacgttacctttacgttccggtacctacccgtttcgggacccgtaagggtaccacggaacgtagggaacgtaaacgttaaacgtaacgtggttacggcttacggcaacctaattcttagttcctttccaacgtttccccg

SEQ ID NO: 335291 - DNA, 616 bp, Homo sapiens
  misc_feature: GZ8MTXP01CDXC9.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagagacagagtcaccatcacttgcggcagtcagaatattaatgtggttgctggtatcagcaagaaaccgagggaacgcccctatactcctgactaccaacgaacggcgttacttaacgttttaaggaaacggttcgggggtacccagttacgtaaaggttcaggtcccggcacgtaggatcgtaaggggaactaagaaatttccgacttctacctaccataccaacacgcctgcacgtcctagattgtaatttggactaaactttactaactcggtaccctaaacggttattaacggttactttacgtccggtacctaaccgttccggaccgtaaacggggactacggaactacgggaagtaacgttaaacgactagggttcgcgttacgcacctaattcgtcgttacttccgttaactttcccg

SEQ ID NO: 335292 - DNA, 614 bp, Homo sapiens
  misc_feature: GZ8MTXP01BBRNK.22.57.F02.1.454.CMB.2.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatcgtgtagganacagagtcaccatcacttgcggcagtcagtaatattaatgttgtgctggtatnagcaagaaaccagggaaacgcccctatacctcctgactcgacaaggtctntaacgttagaacgtcggggtccatacgaaggttcaggccggactacgtggatacgagggaacaagtagttcactcctacaccataccaacacgcctagcgtagccctagatagtatttaggacctaacttactacgtacgggaccctaaacggtactaacgtttacttagttccgtaccgtaccgtttccggaaccgtaacgggtacctaacgaacgttaacgggaagtaaaggttaaacgaacgttggttacggttcgttacggaaccctaccgtaacttactcggtttacttaaccttcgtttaacccccg

SEQ ID NO: 335293 - DNA, 659 bp, Homo sapiens
  misc_feature: GZ8MTXP01BV6UO.22.57.F02.1.454.CMB.2.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (407)..(407): a, c, t, g, unknown or other
  misc_feature (407)..(407): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgagganacagagtcaccatcacttgcggcagtcagaatattaatgttggtgctgatnagcaagaaaccgaggaacncccctatactctgatacccagaacggtcgtacttaactttaaggaaacgggttcggggtaccctagtaccgaaggttcacggccggactacgtggtatcgtaaggggaactaagtaaacttcaactctaccaacatacaacngcctggactacgcctagtattacgtagtttacggacctaaaccgtttactacccgttacgggtaaccccttaaaccgttattaacggttactttaacggttcccggtaccttaaccccggttacggaacccggtaaaacgggaccgtaaaccggaacgttagggaaaggtaaacgttaaaacggaaacgttcgggttcggttcttacggaacctaccgaatttccctagttcccttaacttaaccgttcccc

SEQ ID NO: 335294 - DNA, 536 bp, Homo sapiens
  misc_feature: GZ8MTXP01BT3FA.22.57.F02.1.454.CMB.2.raw
  modified_base (197)..(197): a, c, t, g, unknown or other
  misc_feature (197)..(197): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (511)..(511): a, c, t, g, unknown or other
  misc_feature (511)..(511): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggcctgcatctgtagganacagagtcacatcacttgtcggccagtcagaatattaatagttggtggctggatcagcagaaaccaggaacgcccctatactctgactccacaagctactactttagaacgtgggtcccatacgaagttcagccgacaatggatcgtagggacaagatcactctcaccatacaacngcctncacncctagatgtagtttcgactaacttacctactacgacctaaaccgttatacgttacttacgtcgtcctaccgttcggacgtaaggactgaacgtggaagattaaacgaactgggttcgcttcggcacctntcgtcttacttcttaacgttccccg

SEQ ID NO: 335295 - DNA, 626 bp, Homo sapiens
  misc_feature: GZ8MTXP01BZL1N.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcgggccagtcagaatattaatgttggtgctggtatcagcagaaaccgagggaaacgcccctaatacctcctagactcccaagaacggtccttacttaacgttttaaggaaacgggttcgggggtaccccagttaccgtaaaggtttcacggtccggactacgtgggtactcggtaggggaactaaggtaacttccaactcctaccacctataccaacagcctagcacgtcctagatgtattcgactaacttactacgtcggaccctaaacgttatacgttacttacgttccgtactacccgttcggaccgaagggaccacggaacgtggaaactaaacgttaaacgaacgttggttcggttacttcggaaccacgtaacgttcttacgttccttaacgaaccgtttccccg

SEQ ID NO: 335296 - DNA, 518 bp, Homo sapiens
  misc_feature: GZ8MTXP01BWAFO.22.57.F02.1.454.CMB.2.raw
  modified_base (196)..(196): a, c, t, g, unknown or other
  misc_feature (196)..(196): n is a, c, g, or t
  modified_base (240)..(243): a, c, t, g, unknown or other
  misc_feature (240)..(243): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggcagtcagatatatgtgtgctgnnnnanaacaggaancctatacncngncanagctatacttagaagtggccatcaagtcagccgnagngatcgtagggacngattcactctacacatacacagcctgcagcctagactgtattacggacctaacttactactacgggacctaaacgtactacgttacttacgttccggtactaccgtcgaccgtaaggacctacggaactaggaagtaaacttaaaccgaagtggacggcttacgctaccaattctcgttaccttcttaacgtttccccg

SEQ ID NO: 335297 - DNA, 663 bp, Homo sapiens
  misc_feature: GZ8MTXP01CXFPR.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatcgacccagtcctcccttccaccctggctgcatctgtaggagacagacgtcacatctacgttggtcggccagtacaagtaattattaagtagttggtgctggtatcgagacaagaaaccgaagggaaaccgtcccctatacctcctagactacccgaacgaacgggtcttacgttaacgtttaaggaaacgggtttcggggtaccctagtacgtaaggttcacggccggacgtaagtggatcggtaaagggacaagtactccactactaccaaccagtaccaacgtacgtcccctaggaccctagtacccgtagtacgttagtacgtttacggaccttaaactttacctacgtacggtaaccctaaacgttagttaacgttacgttacgttccgtacctaccggttacgaaccgtaacgggacctaaggtaacgtagggaaataaacgttaaacggtacgtggttcggcttcggcctactgttcctgttaccttcttccgttcccg

SEQ ID NO: 335298 - DNA, 597 bp, Homo sapiens
  misc_feature: GZ8MTXP01AR5TL.22.57.F02.1.454.CMB.2.raw
  modified_base (408)..(408): a, c, t, g, unknown or other
  misc_feature (408)..(408): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgaggagacagagtcaccatcacttgcggcagtcagaatattaatagttggtggctggtatcagcaagaaaccagggaaacgcccctatacctccctgactccaacgaacggtctacttaacgtttaaggaaaacgttcgggggtacccagttacgaaggttcgaggccggacacgtggatccgtaagggacaagaacttcactctacaccatacaacncgcctgcagcctagactgtatttcggactaacttactacacggaccctaaacgttatacgttacttacgttcggtacctaccgttacggaccgtaaaggggaccaacggaaccgttaggaaagtaaacttaaacggaaacgttggttacggcttaggaaccactaatccgtgttccttcaactttcccg

SEQ ID NO: 335299 - DNA, 576 bp, Homo sapiens
  misc_feature: GZ8MTXP01AB6C6.22.57.F02.1.454.CMB.2.raw
  modified_base (468)..(468): a, c, t, g, unknown or other
  misc_feature (468)..(468): n is a, c, g, or t
  modified_base (545)..(545): a, c, t, g, unknown or other
  misc_feature (545)..(545): n is a, c, g, or t
  modified_base (569)..(569): a, c, t, g, unknown or other
  misc_feature (569)..(569): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtctcccttccaccctggctgcatcgtggtaggagacagacgtcaccatcacgttggtcgggccagtcaagtaattattaagtgttggttgcctggtatcagacagaaaccgaggaaacgcccctatacctctgactaccactaaggtctacttagtttaaggaaacggttcgggtaccagtacgtaaggttcacggccgcacgtggactcgtaagggactaagtactcactctacacatacaacgtagcctgcagcctagactgtattcgactaacttctaccgtcggactaaaccggttnttacgttacttacgttccgtactacccgtacgaccgaaagggccaagtaacgtaggaagtaaacttaacgattcggngcttagcactgtctacgttcttcncctcccg

SEQ ID NO: 335300 - DNA, 746 bp, Homo sapiens
  misc_feature: GZ8MTXP01AY5W9.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacgttgtcgggccagtcagtaatattaatagttggttggcctggtatcagacaagaaaccgagggaaacgcccctatactcctgactccacgaaggtcgtacttaacgtttaaggaaacggttcgggggtacccctaagtacgtaaacgggttcgacggcccggactacgtggtactcggtaaagggggaactaaggtaaacttccaaccttcctaccaacctacttacccaaaccgacgcccttacggacgtaacgtcccgtaggaacttagggtaacgttttacgggaaccttaaacctttacgttaaccgtaccgggtaaacccgttaaaccggtttattaacgtttaaccgtttacgttcccgggttaccctaaccccggtttccgggaacccgaaacggggtaccctaaaccgggtaacgtaacgggttaaacgtaaacgttaaaaccggtaaacgttcgggttcggttccttacggaaccctaacccgtcgttaccgttacgttccctttaaccgttaacgtttcccccg

SEQ ID NO: 335301 - DNA, 636 bp, Homo sapiens
  misc_feature: GZ8MTXP01CJJUG.22.57.F02.1.454.CMB.2.raw
  modified_base (196)..(196): a, c, t, g, unknown or other
  misc_feature (196)..(196): n is a, c, g, or t
  modified_base (420)..(420): a, c, t, g, unknown or other
  misc_feature (420)..(420): n is a, c, g, or t
  modified_base (596)..(596): a, c, t, g, unknown or other
  misc_feature (596)..(596): n is a, c, g, or t
  modified_base (614)..(614): a, c, t, g, unknown or other
  misc_feature (614)..(614): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctgctgcatctgtagganacagactcaccatccacgttggtacggccagtcaagtaattattaatagttggttggctggtatcagacaagaaaccgaagggaacgcccctaatacctcctagactccaagacggtctacttaacgtttaggaaacggtcggggtaccagtacgaacggttcaggccgtacacgtggatccgtaagggactaagtacttcacttctaccacctataccaaacncgtcctgacacgtctagtatcggtagtttacgacctttaaactaaccggttactaccgggtaaacccttaaacggttacttacggttaacttcgttacccgtacgtacccgttccggaaccgtaacgggaccacggtaactagggaactaaacgttaaaccgagttcggacggttnttaccgtctaacgtcttntcgttactcgttaacttccccg

SEQ ID NO: 335302 - DNA, 529 bp, Homo sapiens
  misc_feature: GZ8MTXP01AFEGF.22.57.F02.1.454.CMB.2.raw
  modified_base (195)..(195): a, c, t, g, unknown or other
  misc_feature (195)..(195): n is a, c, g, or t
  modified_base (240)..(243): a, c, t, g, unknown or other
  misc_feature (240)..(243): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (506)..(506): a, c, t, g, unknown or other
  misc_feature (506)..(506): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtagganacagagtcacatcacgttgcggcagtcagaatatatgtgtgctgnnnnanaacngaacnccatcncngactcanagctntattagaagtcggtaccatcaagtcagcgcatgatnaagggacaagtatcatctnaccatacaacngtcctacgcaacgcctagtacgtgtaacgttgaacttaaccgttactaccgtacggacctaaaccggttataacgttacttaacgttccggtacctaccgttcggaccgtaacggacacggaagtacggagtaacttaacgtaaacgtgttacggcttacgctacncttctacgttctcttcttccccg

SEQ ID NO: 335303 - DNA, 631 bp, Homo sapiens
  misc_feature: GZ8MTXP01EEOK2.22.57.F02.1.454.CMB.2.raw
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatataatagtggtgctgtancancagaaacaggaaancccctatactctgactccacgaaggcgttactaacgtttaaggaaagggttcggggtacccaagttactaaaggttcacggaccggactacgtggggaacttccggtaaaggggtaacctaagtaaatttcccgaacttccttaccaaccctaaattacccaaacgacgccctaggccaagtccctaggtatagtactttaggaccctaaattactactcggaaccctaacgttaattacgtacttagttccggtactaccgttcggacctaaagggacctaacgaacgtagaacgtaaacttaaaacggtactggttcggcttacggaaccctataacctttcgtcgtttcctaaccttaacgtcc

SEQ ID NO: 335304 - DNA, 576 bp, Homo sapiens
  misc_feature: GZ8MTXP01AUF17.22.57.F02.1.454.CMB.2.raw
  modified_base (198)..(198): a, c, t, g, unknown or other
  misc_feature (198)..(198): n is a, c, g, or t
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (384)..(384): a, c, t, g, unknown or other
  misc_feature (384)..(384): n is a, c, g, or t
  modified_base (545)..(545): a, c, t, g, unknown or other
  misc_feature (545)..(545): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtctccttccaccctggctgcatctgtagganacagagtcacatcacttgcggcagtcagaatattatagttggtgctgtatnagacagaacgaggaacnccctatactctgactaccagacgcgtacttaacgtttaggaagtcgggtaccagtaccgaggttcagccggactacgtggatcgtaagggacaagtactcgactctacacatacaacncgctgcacggctaggtatacgtagttacggactaacttactactacgggtaccaaacgttattaacgttactttacgttccgtactaccgttcggaaccgtaacgggacctaccggaagtacggttaataaacgttaaacgtacgtggttcgcacggaacncctaagttctcgttctaacgttctttccccg

SEQ ID NO: 335305 - DNA, 659 bp, Homo sapiens
  misc_feature: GZ8MTXP01CWVCX.22.57.F02.1.454.CMB.2.raw
  modified_base (198)..(198): a, c, t, g, unknown or other
  misc_feature (198)..(198): n is a, c, g, or t
  modified_base (632)..(632): a, c, t, g, unknown or other
  misc_feature (632)..(632): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtctccttccaccctggctgcatcgtgtaganacagacgtcacatctacttggtcggcagtacaagtaattattaataggttggtcggcttaggtactcagacgaagaaaccgaggaactcccctatactcgtagactaccaacgaaggtccttactaacgtttaaggaaacggttcgggtaccctagtacgtaaacggttcacggtaccccggactacgtagggtactacgtaaacgggaactaaggtaacttcaacgttccaacaactactacaactacgccgtagaccaacgtccgtagtacgttgtaaacgtttcgaaccttaaacgtttacaacgtccggtaacctaaacggttatacgtttacttacgtccgtcttaacccgtgaaccgaaagggccaacggtaagtacgaaaggttaaaccttaaaaggtccgtgttacggttcttcgaacctaccttntccgttcgttaccttcttaacgttccg

SEQ ID NO: 335306 - DNA, 557 bp, Homo sapiens
  misc_feature: GZ8MTXP01DBLIA.22.57.F02.1.454.CMB.2.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctccaggtgccaagtgtgacatccagatgacccagtctccttccacctggctgcatctgaggagacagagtcaccatcacttgtcgggccagtcaagaatattaatagtggtggctgtatcagcagaaacagggaancccctatactctgactccanaaggctactactttagaaagtggggtacccatcaaaggttcacgccggacacgtgggtataccgtaggggaaccaaggtaaattcaactctacacccatacaacaacnccncncacgctagtatagtagtagtactaactactactacgtactaacgtaactagtacttacgttcgtacgtacgtacgtacgaacggacgacgaacgtagagtaagttaaacgtaacgtacgttacgttcgttcgcactaactctcttacttcgttctcc

SEQ ID NO: 335307 - DNA, 581 bp, Homo sapiens
  misc_feature: GZ8MTXP01DUNZM.22.57.F02.1.454.CMB.2.raw
  modified_base (249)..(250): a, c, t, g, unknown or other
  misc_feature (249)..(250): n is a, c, g, or t
  modified_base (267)..(267): a, c, t, g, unknown or other
  misc_feature (267)..(267): n is a, c, g, or t
  modified_base (392)..(393): a, c, t, g, unknown or other
  misc_feature (392)..(393): n is a, c, g, or t
  modified_base (505)..(505): a, c, t, g, unknown or other
  misc_feature (505)..(505): n is a, c, g, or t
tcagacatacgcgtcacgaccggtgctcgatttagctcgatatagttggggtttgggggagtcagacccagtcaggacacagcatggacatgagggtccccgctcagctcctggggctcctgctgctctggctcccaggtgccaagtgtgacatccagatcgacccagtcctcccttccaccctggctgcatcgtggaggagacagagtcacatcacgttgcggcagtcagtaatatatgtgtgctgtnnagacaagaacaggaacncccctatactcagactccaagacggtctactaacgtttaagaaacgggtcgggtaccagttacgaaggttcagtcccggcacgtggactcggtagggaacaagtactcacttcacacatacaacnncctgcagtctagactgtattcgaactaacttacgtacctacggaaccttaaacggtattacgttacttcgttccggtacctaccgttcggtaaccgaaagggtccaaacggngtaaggacgtaaacttaaacggacgttggttacggcttacgaacctaactgttcctgttccttcgaaccttccccg

SEQ ID NO: 335308 - DNA, 573 bp, Homo sapiens
  misc_feature: GZ8MTXP01B8D13.22.57.F02.1.454.CMB.2.raw
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (564)..(564): a, c, t, g, unknown or other
  misc_feature (564)..(564): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgagganacagagtcacatcacttggcggcagtcagtaatatatgtgtgctgancancagaacaggaacnccctatcnctgactccagagtctactaacgttagaagtcgggcctatcgtaagttcaggtccgcacgtggactcgtaagggaacaagtacttcactctacaactatacaacagcctggctagtcctagtacttgtaaacgtttcggaaccttaaacttacctaacctacgggggaaccccttaaacgttataacggtttaactttacgtccggtaacctacccggttacgaaccgtaacggacctagaacgtaggaataagttaaaccgtagtggttcgcttgaacctactgtctcttcgttcncgttccccg

SEQ ID NO: 335309 - DNA, 569 bp, Homo sapiens
  misc_feature: GZ8MTXP01BO3AJ.22.57.F02.1.454.CMB.2.raw
  modified_base (243)..(244): a, c, t, g, unknown or other
  misc_feature (243)..(244): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctcccttccaccctggctgcatctgtaggagacagatcacatcacttgcggcagtcaatatatatgtggtgctgtannagacaacgaacgaaggacctcctatcctacagactaccaagacgtctacttagttaagaacggtcggtaccatacgtaagtcgacggccgactacgtgtatcggaagggacaagtactcactcactacactacaacncacctgcacgtntangttagttattacgacttaacttacgtacctcggtaaacctaacgttattaaccttagttactccggtactaccggtacgacgtaaacggcaacggaatggaaagttaacttaaacggacgttggttcggcttcgaaactacgtaatcggtattcctcgttaaccgtttccccg

SEQ ID NO: 335310 - DNA, 601 bp, Homo sapiens
  misc_feature: GZ8MTXP01CP2PL.22.57.F02.1.454.CMB.2.raw
  modified_base (396)..(396): a, c, t, g, unknown or other
  misc_feature (396)..(396): n is a, c, g, or t
  modified_base (451)..(451): a, c, t, g, unknown or other
  misc_feature (451)..(451): n is a, c, g, or t
  modified_base (571)..(571): a, c, t, g, unknown or other
  misc_feature (571)..(571): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgtcggccagtcagaatatatgttgtgctgatcagcagaaccaggaacgccctatactcctgactccacgaaggtcgttactaacgtttaggaaaggttcgggggtacccagttactaaggttcacgccccggcacgtgggactcgtaggggaacaagtaacttcgactctacaccatccaacngcctgcagcctagactgtatttcggactaacttactactcgggacctaaacgttntacgttacttacttccggtactacccgttcggacccgaaagggtccaaccggtaacgtacgggttaaacgtaaacgttaaaccggtaacgttggttacgggcttacggaacctaccggtnttccgtcgttacttccttaacgtttccccg

SEQ ID NO: 335311 - DNA, 521 bp, Homo sapiens
  misc_feature: GZ8MTXP01DBWF9.22.57.F02.1.454.CMB.2.raw
  modified_base (246)..(246): a, c, t, g, unknown or other
  misc_feature (246)..(246): n is a, c, g, or t
  modified_base (248)..(249): a, c, t, g, unknown or other
  misc_feature (248)..(249): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcacatcacttgtcggcagtcagaatattaatagttgtgctgatnannagaacaggaagccctatactcngatcanaagcgtatacttagaaagtgggccatcaagtnagcgnacnganctgggacaagaatcaactctacactancaacagcctagcacgctagtatagtagttagtactaacttaactactacgtactaacgtaactacgtacttacttcgtacgtaccgtacgtacgaacggacgacgaacgtacgagtaaagttaaacgtaaacgtagttacgcgacgaacacaacgtctcgttcttcgttcgtcg

SEQ ID NO: 335312 - DNA, 795 bp, Homo sapiens
  misc_feature: GZ8MTXP01DWKTT.22.57.F02.1.454.CMB.2.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttcacctggctgcatctgtagagacagagtcaccatcacttgcggcagtcaagtaatattaatagttggtggctggtatnagcagaaacagggaacnccctatactcctagactaccaacgtaacggcgttacttaacgtttaaggaaaacggtttcgggggtaccccaagttaccgaaaagggtttccgaaggtacccggactaaaagttgggaattacccgtaaggggaaacctaagggtaaaacttttacccaaaccttaccgttaacccaaaccccgaaattaacccgaaaaaccgtaacccgtacccgtacggaccgtaaccgtacccgttagttaacgttaggttaacgtttaacggaaaccttaaaccgtttaaaccgttaaccgttaaccgggtaaaccccgttaaaaccggtttaaactttaaaccggtttaaccgtttaccgttacccggttaccgttaaaccccggtttacccggaaaccggtaaacgggaaccgtaaaccgggtaaacgtaaggttaaacgttaaacgttaaaacggtaacgttcggttacggttcgttacgtaacctaaccgttaacgttccgttacgttaccttaacgttaaccgttcccg

SEQ ID NO: 335313 - DNA, 712 bp, Homo sapiens
  misc_feature: GZ8MTXP01AHEDG.22.57.F02.1.454.CMB.2.raw
  modified_base (189)..(189): a, c, t, g, unknown or other
  misc_feature (189)..(189): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
tcagacatacgcgtcacgaccggtgctcgatttagctcgatatagttgggtttggggagtcagacccagtcaggacacagcatggacatgagggtcccgctcagctcctggggctcctgctgctctggctccaggtgccaagtgtgacatccagatgaccagtctctcacctggctgcatctgtagganacagagtcacatcattgtcggcagtcagatatatgtgtgctgatnagcagaacaggaancccctatactctgataccacaggctactacgtttagaaacgttgggggtaccacgttcgaagttcgaacgtaccggcctaaagtacgggaacttcgtaacgggggaaactaagggtaaactttacccggtaaacttccggtacctaacctaacttaccgaaacctaacgggtacccttacggacccgtaagtcccctacgggtaattacgggttaaacgttttcgggaaccttaaaccgttaacttaaccgttaccgggtaaccgttaaaaccccggttattaacggttaaacctttcgtttacccggtaacccttaacccgggttccgtaacccgtaaacggggtaccgaaaccggtaaccggtaagggacgtaaaccggttaaaaccgtaaccggttacgttacggttcctttacgggaacaccttaacgttcgtacggttcttaaccaacgtttaaccccg

SEQ ID NO: 335314 - DNA, 499 bp, Homo sapiens
  misc_feature: GZ8MTXP02I9TGP.22.57.F02.1.454.CMB.2.raw
  modified_base (248)..(248): a, c, t, g, unknown or other
  misc_feature (248)..(248): n is a, c, g, or t
  modified_base (458)..(458): a, c, t, g, unknown or other
  misc_feature (458)..(458): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatataatgttggtgctggtancagcagaaaccaggaaagcccctatactcctgatccacaaggcgtctacttagaaagtgggtcccatcaaggtcagccggcaatggatcgtgggacagaattcactctcacatcaaacagcctgcagcctgatgatttggactaacttactactgaccaaccgtattagtacttattcggtacaccttcggccaagggcacggactgganaacttaaacgaactgtacgctgcacatctgtcttcattccc

SEQ ID NO: 335315 - DNA, 589 bp, Homo sapiens
  misc_feature: GZ8MTXP02J4MTQ.22.57.F02.1.454.CMB.2.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggtggctggtancagcaagaaaccngggtaaaccnccctatctctgactcagaggtctactaacgttaggaaggtcgggtaccatacgaaggtcaggccgcacgtggatcgtagggacagtaacttcactcctacaccataccaacacgtcctcgcgacgcgtagtatagttagtttacgtactaaccttaacttactacgtaccgtaaccgttaacgttaacgttacgtttacgttaccgttaccgtaccgtaccggtaccggaacggaacgaacgtacgtacggtaagtaaacgtaaacgtaaacgtacgtcgtcgtcgtcgactactcttcttcttcttacttccg

SEQ ID NO: 335316 - DNA, 499 bp, Homo sapiens
  misc_feature: GZ8MTXP02F0T24.22.57.F02.1.454.CMB.2.raw
  modified_base (349)..(349): a, c, t, g, unknown or other
  misc_feature (349)..(349): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagtggttggctggtatcagcagaaaccaggaaagcccctatactcctgatccacaaggcgtctactttagaaagtggggtcccatcaaggtcagcgcaatggatctgggacngaattcactctcacatcaaacagcctgcagcctgatgatttggcaacttactactgaccaacgtatagtacttatcggtacaccttcggcctaagggacacgactggagacttaaacgaactgtacgctagcacatctgtcttcacttcc

SEQ ID NO: 335317 - DNA, 517 bp, Homo sapiens
  misc_feature: GZ8MTXP02GS29R.22.57.F02.1.454.CMB.2.raw
  modified_base (357)..(357): a, c, t, g, unknown or other
  misc_feature (357)..(357): n is a, c, g, or t
  modified_base (490)..(490): a, c, t, g, unknown or other
  misc_feature (490)..(490): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagccggcactggatctggggacnggaattcactctcacatcaaacagcctgcagcctgactgatttggcaacttactactgcctaaccgtatacgtacttattccggtctaccgttcggaccgaagggacacgacgtggagacttaaaacgactgnggtctgcaccatcagtcttcacttccc

SEQ ID NO: 335318 - DNA, 497 bp, Homo sapiens
  misc_feature: GZ8MTXP02G8J4V.22.57.F02.1.454.CMB.2.raw
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (486)..(486): a, c, t, g, unknown or other
  misc_feature (486)..(486): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggctggtatcagcagaaaccaggaaagcccctatactcctgatccanaaggcgtctactttagaaagtggggtcccatcaaggttcagccggcactggatctgggacagattcactctcacatcaaacngcctgcagcctgatgatttggactaacttactactgacctaacgtatagtacttatcgtcacttcgccaaggacncgactganataaacgaactgtaggctgcaccgatcgntcttcacttcc

SEQ ID NO: 335319 - DNA, 505 bp, Homo sapiens
  misc_feature: GZ8MTXP02ILIRJ.22.57.F02.1.454.CMB.2.raw
  modified_base (377)..(377): a, c, t, g, unknown or other
  misc_feature (377)..(377): n is a, c, g, or t
  modified_base (461)..(461): a, c, t, g, unknown or other
  misc_feature (461)..(461): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggcagtcagaatattaatagttggttggctggtatcagcagaaaccaggaaacgcccctatactcctgatccacaaggcgtctaactttagaaaagtggggtacccatcaaggttcagccggcactggatctgggacagaattcactctcacatcaacngcctgcagcctgatgatttgacaacttactactgacctaaccgtatagtacttatcgtactaccttcgcaaggacacgactganacttaaacgaactgacgtctagcaccatcgtatcttacattccc

SEQ ID NO: 335320 - DNA, 491 bp, Homo sapiens
  misc_feature: GZ8MTXP02HVPTF.22.57.F02.1.454.CMB.2.raw
  modified_base (480)..(480): a, c, t, g, unknown or other
  misc_feature (480)..(480): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatagttgtggctgtatcagcagaaaccaggaaagcccctatactctgatccacaaggcgtctactttagaaaagtggggtcccatcaaggttcagccggcacgtggatctgggacagaattcactcctcaccatcaacagcctagcagcctgatgatttggactaaacttactaactgacctaacgtatagtacttatcgcactcgacaaggcacgactgagactaaacgactgtagctgcacatcngtctacatccc

SEQ ID NO: 335321 - DNA, 504 bp, Homo sapiens
  misc_feature: GZ8MTXP02FZB2R.22.57.F02.1.454.CMB.2.raw
  modified_base (354)..(354): a, c, t, g, unknown or other
  misc_feature (354)..(354): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagccgcactggatctgggacngaattcactctcaccatcaaacagccctgcagccctgatgatttggactaacttactactgccaacgtatagtacttattcggtcaccttcggcctaaagggcacgactggatattaaacgactgtacgctgcacatctgtctcattccc

SEQ ID NO: 335322 - DNA, 481 bp, Homo sapiens
  misc_feature: GZ8MTXP02GX1WC.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggccagtcagaatattaatgtgtgctggtatcagcagaaacaggaaagcccctatactctgatccacaaggcgtctacttagaaagtgggtccatcaagtcagccggcaatggatctgggacagaatcactctcacatcaaacagcctgcagcctgatgatttgacaacttacactgaccaacgtatagtactatcgtcacttcgactaaggacacgactggatacttaaacgactgtaggctgaacacatctgctttcacttcc

SEQ ID NO: 335323 - DNA, 582 bp, Homo sapiens
  misc_feature: GZ8MTXP02FTUR0.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatgttggtgctggtatcagcagaaaccagggaaagcccctatactcctagactccacaaggcgtactacgtttaagaaaagtcggggtacccagtacgaaaggtttcaggtccggactaaagtggatcgtaggggaacagtaattcactcctcacatcaacagccctgcagccctagatgatttgactaacttactactcgacctaacgttataagttacttacgttcggtacctaccgttcggaccgaaaggggacaacggaacgttacgggaaataaacgttaaaacgaaacgttggttacgggactaggaaccaaccgtattacgtgttacctactactttccccg

SEQ ID NO: 335324 - DNA, 495 bp, Homo sapiens
  misc_feature: GZ8MTXP02FSYMH.22.57.F02.1.454.CMB.2.raw
  modified_base (344)..(344): a, c, t, g, unknown or other
  misc_feature (344)..(344): n is a, c, g, or t
  modified_base (457)..(457): a, c, t, g, unknown or other
  misc_feature (457)..(457): n is a, c, g, or t
  modified_base (486)..(486): a, c, t, g, unknown or other
  misc_feature (486)..(486): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagtgtgctggtatcagcagaaaccaggaaagcccctaatactcctgatccacaaggcgtctactttagaaagtgggtcccatcaagtcagccgcaatggatctggacngaattcactctcacatcaaacagcctgcagcctgatgattggacaacttactactgacctaacgtatagtacttattcggtcaccgttcggaccaaagggacacgactggaanaattaaacgaactgtagctgcacatcgtntctctactc

SEQ ID NO: 335325 - DNA, 562 bp, Homo sapiens
  misc_feature: GZ8MTXP02G0XF4.22.57.F02.1.454.CMB.2.raw
  modified_base (352)..(352): a, c, t, g, unknown or other
  misc_feature (352)..(352): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctacttagaaagtggggtccatcaaggttcagccgcactggatctgggacngaattcactctcacatcaacagcctgcagcctgatgtatttggactaacttactactcgacctaaccgtatacgttacttagttcggtactaccgttcggaccgtaaggggacaacggactagggaagtaaactttaaaacggaaaccttggtacggacttcggaacctaacccgtaacttccgttgttacctttacaacttttcccccg

SEQ ID NO: 335326 - DNA, 527 bp, Homo sapiens
  misc_feature: GZ8MTXP02HM2LR.22.57.F02.1.454.CMB.2.raw
  modified_base (285)..(285): a, c, t, g, unknown or other
  misc_feature (285)..(285): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgtcgggccagtcagaatataatagttgtgctggatcagcagaaaccaggaaagcccctatactctgatccanaaggctctacttagaaagtgggtccatcaaggttcagccggacaatggatcgtgggacagaattcactctacacatcaaacagcctgcagcctgatgatttggactaaacttactactgacctaaaccgtatagtacttagttcggtctaccttcggaccaagggacacggtactaggaagtaaacttaaaacgaacttgtacggtactcggaacctaccaatcctgtcttctaacttcccg

SEQ ID NO: 335327 - DNA, 500 bp, Homo sapiens
  misc_feature: GZ8MTXP02ISVP2.22.57.F02.1.454.CMB.2.raw
  modified_base (454)..(454): a, c, t, g, unknown or other
  misc_feature (454)..(454): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatgttggttggcctggtatcagcagaaaccagggaaagcccctatacctcctgatccacaaggctctacttagaaagtggggtccatcaaggttcagcgcatggatctgggacagaattcactctcacatcaaacagcctgcagccctgattgatttggcaacttactactgacctaacgtatagtacttattcgtactacttcggactaggacacgacngagataaacgactgcgctgaacacacgtctagtctactacttcccg

SEQ ID NO: 335328 - DNA, 527 bp, Homo sapiens
  misc_feature: GZ8MTXP02JVBAO.22.57.F02.1.454.CMB.2.raw
  modified_base (355)..(355): a, c, t, g, unknown or other
  misc_feature (355)..(355): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctacttagaaagtggggtcccatcaaggttcagccggcactggatcgtgggacngaattcactctcacatcaaacagcctgcagccctagatgatttggactaacttactactgaccaaccgtatagtacttattcggtactaccttcggacctaagggacacgacgtaggaacgacgttaaaacgactagtacggtacctgccaccatctgtcttcatttccccg

SEQ ID NO: 335329 - DNA, 538 bp, Homo sapiens
  misc_feature: GZ8MTXP02H9M3C.22.57.F02.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (383)..(383): a, c, t, g, unknown or other
  misc_feature (383)..(383): n is a, c, g, or t
  modified_base (486)..(486): a, c, t, g, unknown or other
  misc_feature (486)..(486): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcgggccagtcagaatattaatagttggtgcctggtatcagcaagaaaccaggaaagcccctatactcngatccacaaggcgtctacttagaaagtggggtccagtactaaggtcagccggcacgtggatcgtgggacagtaattacactctacaccataccaaacncgctacgcagcctagatgtaatttcggactaacttactactacgactaaacgtataacgtacttagtcgtctaccgttcggacaacgggacaacgtacagganaaacttaaaacgactaggtacgctacgaactaccatctcttctctactcccc

SEQ ID NO: 335330 - DNA, 520 bp, Homo sapiens
  misc_feature: GZ8MTXP02HT2CV.22.57.F02.1.454.CMB.2.raw
  modified_base (247)..(248): a, c, t, g, unknown or other
  misc_feature (247)..(248): n is a, c, g, or t
  modified_base (250)..(251): a, c, t, g, unknown or other
  misc_feature (250)..(251): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (488)..(488): a, c, t, g, unknown or other
  misc_feature (488)..(488): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctcccttccaccctggctgcatctgtaggagacagagtcaccatcacttgcggccagtcaagtatataatgttggtgctgnnannaagaacgaggaccncctanactcngactcagagctactatagaaggtcggcanagtagtngccgnagngactgagangtatcactcacacanacacncncctnacacgctagactgttagttgacttaacttactctacgacccttaacgtattacttacttcgtaccggtacctccgtacggaaccgaaggaccacgtacggaggtaaataaacgtaaacgtactcggtcgacganaactaacatttcagttccttctacgtttcccc

SEQ ID NO: 335331 - DNA, 542 bp, Homo sapiens
  misc_feature: GZ8MTXP02I1E5L.22.57.F02.1.454.CMB.2.raw
  modified_base (346)..(346): a, c, t, g, unknown or other
  misc_feature (346)..(346): n is a, c, g, or t
tcagacatacgcgtcacgaccggtgctcgatttagctcgatatagttgggttggggagtcagacccagtcaggacacagcatggacatgagggtccccgctcagctcctggggctcctgctgctctggctcccaggtgccaagtgtgacatccagatgacccagtctccttccaccctggctgcatcgtgtaggagacagagtcaccatcacttgtcggccagtcagatataatagtgtgctggtatcagcagaaaccagggaaacgcccctatactcctgatccacaaggcgtctacttagaaagtggggtcccatcaaggtcagccggcactggatctgggacngaattcactctacaccatcaaacagctcgcagcctagatagtaattggtactaacttactactacgtacctaaccgtaactagttaacttaacttacggttactaccttacggtaccgtaacggaacgaacgaacgtaggaagaagtaaacgtaaacgtacgtagtacgtgcgacaactactcgtcttctacttcc

SEQ ID NO: 335332 - DNA, 541 bp, Homo sapiens
  misc_feature: GZ8MTXP02JJRI5.22.57.F02.1.454.CMB.2.raw
  modified_base (243)..(243): a, c, t, g, unknown or other
  misc_feature (243)..(243): n is a, c, g, or t
  modified_base (360)..(360): a, c, t, g, unknown or other
  misc_feature (360)..(360): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagatatatgtgtgctgtancagcagaaccaggaacgccctatactctgactccacaaggctctactttagaagtgggtccatcaaggtcagccggcacgtgatcgtagggacagtaattcactcacacatcaaacngcctgacagcctagatgtattggactaactttacactcgacctaaccgtatacgttacttagttacggtactaccgttcggaccaagggtaccacggtactagggaagtaaacgttaaaacggaacttggtacggtactacgaacgaacctaacttcgtacgttcctttacactttccccg

SEQ ID NO: 335333 - DNA, 571 bp, Homo sapiens
  misc_feature: GZ8MTXP02F44SR.22.57.F02.1.454.CMB.2.raw
  modified_base (243)..(244): a, c, t, g, unknown or other
  misc_feature (243)..(244): n is a, c, g, or t
  modified_base (246)..(247): a, c, t, g, unknown or other
  misc_feature (246)..(247): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcaagatatatgtgtgctgtnnannaagaacgaggaacncctancncnacncagagctacttagtaagaaggtcggtaccatacgtaagtcaggccgacacgtgactcggtaggaacagtactcactctacaacactacaaacncncctgacncgtccgtanacgttagttacggtttacgaaccttaaactttactaccgtacgaacccgttaacgttaattacgtttacttacggttacgtacctaccggttacggaccgtaaaggaccgacgtagtacggaaataaacgttaaaacgacgttggacggctacgaactaaacgttcttctacgttctactacctccg

SEQ ID NO: 335334 - DNA, 521 bp, Homo sapiens
  misc_feature: GZ8MTXP02GM5UD.22.57.F02.1.454.CMB.2.raw
  modified_base (196)..(196): a, c, t, g, unknown or other
  misc_feature (196)..(196): n is a, c, g, or t
  modified_base (507)..(507): a, c, t, g, unknown or other
  misc_feature (507)..(507): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcgggccagtcagaatattaatgtggtgctggtatcagcagaaaccaggaaagcccctatactcctgatccaacaaggcgtactactttagaaaagtggggtacccatcaaggttcagccggacaatggatcgtgggacagaattcactctcacatacaaacagcctgcagcctagatgatttggactaacttactactgaccaacgtataagtacttatcggtacaccttcggaccaaagggcaacgactggaataacttaaaacgaactgtacggctagaacacctatctntcttacactttccc

SEQ ID NO: 335335 - DNA, 544 bp, Homo sapiens
  misc_feature: GZ8MTXP02JG43A.22.57.F02.1.454.CMB.2.raw
  modified_base (355)..(355): a, c, t, g, unknown or other
  misc_feature (355)..(355): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccagggaaagccccctatactcctgatccacaaggcgtctactttagaaagtggggtccatcaaggttcagccggcactggatctgggacngaattcactctcaccatcaaacagccctgcagccctagatgtagttgactaacttacactcgacctaacgtattacgttacttacgtcggtactaccgttcgaccgtaacggacacgtacgtaggagtaaacgtaaaacaacgtcgtacggctacgcctaactacttctagttccttactactttcccc

SEQ ID NO: 335336 - DNA, 496 bp, Homo sapiens
  misc_feature: GZ8MTXP02IPKM3.22.57.F02.1.454.CMB.2.raw
  modified_base (351)..(351): a, c, t, g, unknown or other
  misc_feature (351)..(351): n is a, c, g, or t
  modified_base (372)..(373): a, c, t, g, unknown or other
  misc_feature (372)..(373): n is a, c, g, or t
  modified_base (462)..(462): a, c, t, g, unknown or other
  misc_feature (462)..(462): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggctggtatcagcagaaaccagggaaacgcccctatactcctgatccacaagcgtctacttagaaagtgggtaccatcaaggtcagccggcactggatcgtggacngaattcactctcacatcaacnncctgcagcctgatgtatttgactaacttactactcgacctaacgtatagtacttattcgtactacttcgacgaagggacacgactgganattaaacgactgcgctgcacatctgtctcactcc

SEQ ID NO: 335337 - DNA, 499 bp, Homo sapiens
  misc_feature: GZ8MTXP02H8219.22.57.F02.1.454.CMB.2.raw
  modified_base (348)..(348): a, c, t, g, unknown or other
  misc_feature (348)..(348): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccaggaaagcccctatactcctgatccacaaggcgtctactttagaaagtggggtcccatcaagtcagccgcactgatctggacngaattcactctcaccatcaacagcctgcagcctgatgatttggctaacttactactgacctaaccgtatagtacttattcggtctaccttcggccaagggacacgactgaagattaaacgaacttgagctgcaccatctgtcttcattccc

SEQ ID NO: 335338 - DNA, 502 bp, Homo sapiens
  misc_feature: GZ8MTXP02IRYNJ.22.57.F02.1.454.CMB.2.raw
  modified_base (375)..(375): a, c, t, g, unknown or other
  misc_feature (375)..(375): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattatgttggtgctggtatcagcagaaccagggaaacgcccctatacctcctgatccacaaggccgtctaactttagaaacgtcggggtccatcaaggttcagccggcaatggatctagggacagattcactctcacatcaacngcctgcagctgatgatttgactaacttactactgccaacgttatagtacttatcggtctacgttcggcctaagggcacgacgtggaacattaaacgactgtacggctgcacatctgtcctcacttcc

SEQ ID NO: 335339 - DNA, 529 bp, Homo sapiens
  misc_feature: GZ8MTXP02GP5Q0.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggtgctggatcagcagaaaccaggaaagcccctatactcctgatccacaagcgtctacttagaaagtgggtccatcaagtcagccgcaatggatcgtgggacagaattcactctcacatacaacagcctgcagcctgatgtaattggactaacttactactgacctaacgtatagtacttactttcggtactaccttacggaccaaagggacaacgacgtaggaaagtaacgttaaaacgaacgtgtacggactagaacctaccaatcctgtacttacctactttcccg

SEQ ID NO: 335340 - DNA, 521 bp, Homo sapiens
  misc_feature: GZ8MTXP02HDCAL.22.57.F02.1.454.CMB.2.raw
  modified_base (197)..(197): a, c, t, g, unknown or other
  misc_feature (197)..(197): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggccagtcagaatattaatgttggtgctggtatcagcagaaaccaggaaagcccctatactctgatccacaaggcgtactactttagaaagtcggggtcccatacaaggttcagccggcactggatcgtgggacagaattcaactctcaccatacaaacagcctgcagccctgactgatttggactaaacttactactgccctaaacgtatacgtacttattcggtactaccgttcgacctaggacacgacgtggacgtaacttaaacgaactgtacggctgcaccatcgtatctactattccc

SEQ ID NO: 335341 - DNA, 505 bp, Homo sapiens
  misc_feature: GZ8MTXP02F9EFK.22.57.F02.1.454.CMB.2.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
  modified_base (469)..(469): a, c, t, g, unknown or other
  misc_feature (469)..(469): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcgggccagtcagaatattaatagttggttggcctggtatcagcagaaaccagggaaagcccctatactcctgatccacaaggcgtctactttagaaagtggggtcccatcaaggttcagccggcactggatctgggacngaattcactctcaccatcaaacagcctgcagccctgatgaatttggactaacttactactgaccaacgtatagtacttattcggtctaccttcggccaagggacacgactgganataaacgactgtagctgcacatctagtcttcattcc

SEQ ID NO: 335342 - DNA, 498 bp, Homo sapiens
  misc_feature: GZ8MTXP02I8ZCM.22.57.F02.1.454.CMB.2.raw
  modified_base (354)..(354): a, c, t, g, unknown or other
  misc_feature (354)..(354): n is a, c, g, or t
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
  modified_base (489)..(489): a, c, t, g, unknown or other
  misc_feature (489)..(489): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagtggttggcctggtatcagcagaaaccagggaaagcccctatactcctgatccacaaggcgtctactttagaaaagtggggtcccatcaaggttcagcggcactggatctgggacngaattcactctcaccatcaaacagcctgcagcctgatgatttggcaacttactactgcaaccgtatagtactatcgtnacttcgccaagggcagactgganattaaacgaaactgtaggctgcgaccaacttctntctctactc

SEQ ID NO: 335343 - DNA, 538 bp, Homo sapiens
  misc_feature: GZ8MTXP02IOEJG.22.57.F02.1.454.CMB.2.raw
  modified_base (370)..(370): a, c, t, g, unknown or other
  misc_feature (370)..(370): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatgttgtggctggtatcagcagaaaccagggaaacgcccctatactctgatccacaaggcgtctacttagaaagtgggtccatcaaggtcagccgcactggatcgtagggacagaattcactctcacatcaaacngcctgcagcctagatgatttggactaacttactactcgacctaacgtattacgtaacttagttccggtactaccgttcggaccctaaggggaccaacgtacgtaggaagtaacgttaaaacgacttcggacggtctcgaactacctatctgttccttctactttcccg

SEQ ID NO: 335344 - DNA, 556 bp, Homo sapiens
  misc_feature: GZ8MTXP02H84LR.22.57.F02.1.454.CMB.2.raw
  modified_base (196)..(196): a, c, t, g, unknown or other
  misc_feature (196)..(196): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcggccagtcagaatattaatgttggtgctggatcagcagaaacaggaagcccctatactctgatccacagcgtctacttagaagtgggtccatcaaggtcagccgnactgatntggacagattcactctcacatcacagctgcagcctgatgtatttcggactaaacttactactacgacctaaaccgtattacgtaactttacgttcggtacctaccgttccggaccaaacgggtaccaaccgtactagggtagtaaaactttaaaaccggaaacgtggtacggtacttacggaacccgtaccgtaacgttctcgtttaccctttctaacctttccccg

SEQ ID NO: 335345 - DNA, 568 bp, Homo sapiens
  misc_feature: GZ8MTXP02F8R17.22.57.F02.1.454.CMB.2.raw
  modified_base (274)..(274): a, c, t, g, unknown or other
  misc_feature (274)..(274): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggctggatcagcagaaaccagggaaacncccctatactcctgatccacaaggcgtctactttagaaagtggggtccatcaaggtcagccgcactggatcgtagggacagaattcactctcacatcaaacagccctgacagccctagacttgtatttggactaactttactactacgacctaaaccgtattaacgttacttacttcggtactaccgttcggaccgaaggggtaccacggtaacgtagggaagtaaacttaaaacggtaacgtgtacggcttaggaacctaaccgtaacttctcgttacttactactttccccg

SEQ ID NO: 335346 - DNA, 527 bp, Homo sapiens
  misc_feature: GZ8MTXP02GL49Z.22.57.F02.1.454.CMB.2.raw
  modified_base (346)..(346): a, c, t, g, unknown or other
  misc_feature (346)..(346): n is a, c, g, or t
  modified_base (475)..(475): a, c, t, g, unknown or other
  misc_feature (475)..(475): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatgttggttggcctggtatcagcagaaaccaggaaacgcccctatactcctgatccacaaggcgtctacttagaaagtgggtccatcaaggtcagcgcactgatcgtggacngaattcactctacacatcaaacagcctgcagcctgatgtatttggactaacttactactacgacctaaacgtataagtacttattcggtctaccgttcgaccgtaaacgggacaacggtactagggaanaacgtttaaacgaacttggacgactgaacacatctcgtacttcactttcccg

SEQ ID NO: 335347 - DNA, 599 bp, Homo sapiens
  misc_feature: GZ8MTXP02IAQHX.22.57.F02.1.454.CMB.2.raw
  modified_base (350)..(350): a, c, t, g, unknown or other
  misc_feature (350)..(350): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgtcgggccagtcagaatattaatagttggttggcctggtatcagcagaaaccagggaaagcccctatactcctgatccacaaggctctactttagaaagtgggtccatcaaggtcagccgcaagtgatctagggacngaattcactctacacatcaacagccctgcagcctgatgatttggctaaacttactacttggaccctaaacggttataacggttactttacgttcggtacctaccgttcgggaccaaaggggacctacggaaccgttagggaacgtaaaacgtttaaaaccggaaacgtttcggtaacggggtaccttcgggtaacccgaccctaaacggtttccttcgggtttaccctttccgtaacgttttccccccg

SEQ ID NO: 335348 - DNA, 548 bp, Homo sapiens
  misc_feature: GZ8MTXP02FW1GX.22.57.F02.1.454.CMB.2.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagtggttggcctggtatcagcagaaaccagggaaagcccctatactcctgatccacaaggcgtctacttagaaagtggggtccatcaaggttcagcggcaatggatctggacngaatcactctcacatcaaacngcctgcagccctgactgatttggacaacttactactgacccaaaccgtataacgtacttaagttcggtactaccgtttcggacctaaaggggacaacgaccgtaggaagtaaacgtttaaaaccgaaacgttggtacggcttaggaacaccctaagtctcgtctttacactttccccg

SEQ ID NO: 335349 - DNA, 538 bp, Homo sapiens
  misc_feature: GZ8MTXP02HJGH2.22.57.F02.1.454.CMB.2.raw
  modified_base (368)..(368): a, c, t, g, unknown or other
  misc_feature (368)..(368): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatataatagttggtgctggtatcagcagaaaccagggaaagcccctatactcctgatccacaggctctacttagaagtgggtccatcaaggttcagccggacaatggatcgtagggacagaattcactctcacatcaacngcctgcagcctgactgatttggactaacttactactacgacctaacgttactagttactttagttccggttactacccgttcggacccgtaaaggggacaccggtaactagggaagtaacttaaaacgactacggtcgctagccacgtactctagtccttacactttccc

SEQ ID NO: 335350 - DNA, 549 bp, Homo sapiens
  misc_feature: GZ8MTXP02INALP.22.57.F02.1.454.CMB.2.raw
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatagttggtgctggtatcagcagaaacaggaaacncccctatactcctgactccacaaggcgtctaactttaggaaaggttcggggtacccagtacgaaggttcaggccggacacgtggatcgtagggacagattcactctacacatacaacngcctgacagcctgattgatttgactaacttactactcgacctaaccgtatacgtacttagttcgtactaccgttcggactaacgggacaacgacgtaggaacgtaacgttaaaacgactcggtacggactgaactaccgtatcctagttccttcactttcccg

SEQ ID NO: 335351 - DNA, 518 bp, Homo sapiens
  misc_feature: GZ8MTXP02J19NT.22.57.F02.1.454.CMB.2.raw
  modified_base (352)..(352): a, c, t, g, unknown or other
  misc_feature (352)..(352): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggtgctggtatcagcagaaccaggaagcccctatactcctgatccacaaggctctactttagaaagtgggtcccatcaaggttcagccggcacgtggatcgtaggggacngaattcactctacaccatcaacagcctgcagcctgatgatttggactaacttactactcgaccaaccgtatacgttacttattcggtactaccgttcggaccaagggacacgactaggagacttaaaacgaactgtcggctagcacctatctagtcttcacttccc

SEQ ID NO: 335352 - DNA, 511 bp, Homo sapiens
  misc_feature: GZ8MTXP02GB000.22.57.F02.1.454.CMB.2.raw
  modified_base (506)..(506): a, c, t, g, unknown or other
  misc_feature (506)..(506): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagtggtgctggatcagcagaaaccagggaaagcccctaatactcctgatccacaaggctctacttagaaagtggggtcccatcaaggttcagccggcactggatctgggacagaattcactctcaccatcaaacagacctgcagccctgactgatttggactaacttactactgacctaacgtatagtacttactcggtctacttcggccaagggacacgactacggataactaaacgaaactgtacggctgcacactctgtcttacnttccc

SEQ ID NO: 335353 - DNA, 551 bp, Homo sapiens
  misc_feature: GZ8MTXP02I4Y6Y.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgcttctctggctcccaggtgccaagtgtgacatccagatgacccagtctccttccaccctggctgcatctgtaggagacagagtcaccatcacttgtcgggcagtcagaatattaatagttggtggctggtatcagcagaaaccagggaaacgcccctatactcctgactccaacaaggcgtactacgtttaggaaagtggggtacccatcgaaaggttcaggcggaccaagtggatcgtgggacaagtattcactctacaccataccaaacacgccctgacagcctgatgatttgactaacttactactcgtacccaaacgttatattacttattccgtactaccgttcggacctaagggacacgactacggaacgaacttaaacgaacgtggtacgctgacaacgatcgtacgtctctactccttacccg

SEQ ID NO: 335354 - DNA, 581 bp, Homo sapiens
  misc_feature: GZ8MTXP02IVK84.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccacctggctgcatctgtagganacagagtcaccatcacttgtcgggccagtcagaatattaatagttggttggcctggtatcagcagaaacaggaaagcccctatactctgatccacaggctctactttagaagtggggtccatacaaggttcagccggcactggatcgtgggaacagtaattcaactctacaccatacaaacagcctgcagcctgatgtatttggactaacttactactacgacctaacgtatagttacttacgttcggtactaccgttcggacctaaacggggccaacgtacgtacgggaaacgtaaacgtttaaaacgaaacgttcggttacggacttacggaaccgtaaccctaacttccggttaacgttccgtttacctaacgtttcccccg

SEQ ID NO: 335355 - DNA, 527 bp, Homo sapiens
  misc_feature: GZ8MTXP02GLJV7.22.57.F02.1.454.CMB.2.raw
  modified_base (291)..(291): a, c, t, g, unknown or other
  misc_feature (291)..(291): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatgttggtgctggtatcagcagaaaccagggaaagcccctatactcctgactccanaaggcgtctacttagaagtgggtccatcaaggttcagccggcactggactcgtggggacagaattcactctacaccatacaaactagcctgcagcctgactgactttggactaacttactactgccaacgtatacgtacttattcggtctaccgttacggtccaagggtacacgtacgtaggaagtaactttaaaacgacgtgtacggctgaaccactactcgtctctctactccg

SEQ ID NO: 335356 - DNA, 505 bp, Homo sapiens
  misc_feature: GZ8MTXP02HIXF1.22.57.F02.1.454.CMB.2.raw
  modified_base (345)..(345): a, c, t, g, unknown or other
  misc_feature (345)..(345): n is a, c, g, or t
  modified_base (497)..(497): a, c, t, g, unknown or other
  misc_feature (497)..(497): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagatataatagttggtgctggtatcagcagaaaccagggaaagccctatactcctgatccacaaggctctacttagaaagtgggtccatcaaggttcagccggcactggatcgtgggacngaacttcaactctcacatcaaactacgcctgctagcctgatgtatttggactaacttacacttgcctaaaccgtatacgtaacttattcgtacaccttcggaccaagggtacaccgacgtgagaacttaaacgaatgtagctgcacatcgtntctcactc

SEQ ID NO: 335357 - DNA, 526 bp, Homo sapiens
  misc_feature: GZ8MTXP02H0U53.22.57.F02.1.454.CMB.2.raw
  modified_base (487)..(487): a, c, t, g, unknown or other
  misc_feature (487)..(487): n is a, c, g, or t
  modified_base (516)..(516): a, c, t, g, unknown or other
  misc_feature (516)..(516): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcgggcagtcagaatattaatagttgtgctggatcagcagaaaccaggaaagcccctatactctgatccaacaaggctactaacgtttaagaaagttcggggtcccaatacgtaaaggttcaagcccggacacgtggatcgtagggacagtaacttcactctaccacaatacaaacagcctgcaagcctagatcgtatttggactaaacttacctacttcgacctaacgtatagtacttatcggactacgtcgaccaagggacacgactagganaacttaaacgactagcgctgcacatcttntctctactcc

SEQ ID NO: 335358 - DNA, 557 bp, Homo sapiens
  misc_feature: GZ8MTXP02JE87P.22.57.F02.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
  modified_base (354)..(354): a, c, t, g, unknown or other
  misc_feature (354)..(354): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggcagtcagaatattatgttggtgctggtatcagcagaaaccaggaaacgcccctanactctgatccacagcgtctacttagaaagtgggtccatcaaggttcagccggcacgtggatcgtggacagaattcactcncacatcaacagcctgcagcctgactgtatttggactaactttactactagacctaacgtattacgtactttacttcggtactaccgttcggaccgaaaggggtaccacggtacgtacgggaaataaacgttaaaacggaaacgttcggtacggtaccttacggaacctaccgtaactcgttacgtacctttacactttccccg

SEQ ID NO: 335359 - DNA, 555 bp, Homo sapiens
  misc_feature: GZ8MTXP02GRK5N.22.57.F02.1.454.CMB.2.raw
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (358)..(359): a, c, t, g, unknown or other
  misc_feature (358)..(359): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccacctggctgcatctgtaggagacagagtcaccatcacttgtcggcagtcagatattaatgttggtgctggatnagcagaaccaggaacgccctatactctgatccanaaggctctattagaagtgggtccatcaaggtcagccggcactggatcgtggacagattcactctcacatccaacnnccctgcagccctgacgtgtacttggactaacttacgtacctaggaccctaaacgtacttaacgttacgttaagttcccggttactaaccgttcggacctaagggaccaacggtaacgtaggaaacgtaagttaaaaccggtacgtagttacggacttacgcgaacctaacgtccttggttcctttacacctttccc

SEQ ID NO: 335360 - DNA, 545 bp, Homo sapiens
  misc_feature: GZ8MTXP02HTESU.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcgggcagtcagaatattaatgttggtggctggtatcagcagaaacaggaaagcccctatacctctgactccacaagcgtactacgttagaaagtgggtccatcaaggtcagccgacaatggatcgtgggacagattcactctcacatacaaacagcctgcagcctagactgtatttgactaacttactactcgacctaacgtattacgtacttacgttcgtactaccgttcggaccgtaagggacacgtacgtaggaaagtaaacttaaaacggacgtaggtacggtctacggaacctacaacttctagtttccttactactttccccg

SEQ ID NO: 335361 - DNA, 523 bp, Homo sapiens
  misc_feature: GZ8MTXP02H19C8.22.57.F02.1.454.CMB.2.raw
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcggccagtcagaatataatgttgtgctggatcagcagaaaccaggaaagcccctatacctcngatccanaagcgtctaacttagaagtgggtccatcgaagtcagccggnactgatcngggacngaaattcactctacaccatacaaacagcctgcacgcctagatagtattacgtactaacttaactacttacgactaaccgtatagtacttattacgtctaccgtcgtaccgaacgacgaacgacgtaggagaaagtaaacgtaacgtacgtagcgtacgcgacaactactcgtcttactacttccc

SEQ ID NO: 335362 - DNA, 564 bp, Homo sapiens
  misc_feature: GZ8MTXP02IWF62.22.57.F02.1.454.CMB.2.raw
  modified_base (333)..(333): a, c, t, g, unknown or other
  misc_feature (333)..(333): n is a, c, g, or t
  modified_base (438)..(438): a, c, t, g, unknown or other
  misc_feature (438)..(438): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagagacagagtcaccatcacgttgtcgggccagtcagaatattaatagttggttggcctggtatcagcagaaaccagggaacgcccctatacctcctgactccacaaggctacttaacgctaaagaaagttcggggtcccanacgtacgtacacgtcgactagtcggatacgtagggacagtaactacctactactacaccactacacacgcctgacagcctgatagtattacgactaactactacncgtacaaaacttgtacttacttacgtacgtactaccgttaccgacgtaaacgggactaacgtaacgtaggaacgtacgtaaacgtacgtgtcgacgtcgacaccgtacttcgtcgttactactccg

SEQ ID NO: 335363 - DNA, 542 bp, Homo sapiens
  misc_feature: GZ8MTXP02JZWJ5.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcggcagtcagatattaatagttggtggcctggtatcagcagaaaccaggaagcccctatactcctgatccacaaggcgtctactttagaaagtggggtccatcgaaggttcaagtccgcgaatggatctgggacagattcgaactctcaccatcaaccagcctgcagccctgactgatttggactaacttactactgacctaaccgtataggttacttattcggtactaccgtttacgccgaagggtacacggtaccgtaggacgtaactttaaaacggacctagtacggcttacggcaacctactcctagttccttcaactttcccc

SEQ ID NO: 335364 - DNA, 532 bp, Homo sapiens
  misc_feature: GZ8MTXP02HCFJB.22.57.F02.1.454.CMB.2.raw
  modified_base (369)..(369): a, c, t, g, unknown or other
  misc_feature (369)..(369): n is a, c, g, or t
tcagacatacgcgtcacgaccggtgctcgatttagctcgatatagttgggtttggggagtcagacccagtcagggggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatagttggtgctgtatcagcagaaaccaggaaacgcccctatactcctgatccacagctctacttagaaagtgggtccatcaaggtcagccggacaagtggatcgtgggacagaatcactctcacatacaacngcctgcagcctgatgtattgactacttactactagacctaacgtatagttacttacgttcgtactacgttcggacgaaacgggacacgtacgtaggagtaaacttaaacggaactcgtacggctacgaactacctacttcgtacgttcttacctactttcccg

SEQ ID NO: 335365 - DNA, 508 bp, Homo sapiens
  misc_feature: GZ8MTXP02HJR9R.22.57.F02.1.454.CMB.2.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatgttggttggcctggtatcagnagaaaccagggaaancccctatactcctgatccacaaggcgtctactttagaaagtggggtcccatcaaggttcagccggcaatgatctggacagaattcactctcaccatcaaacagcctgcagcctgatgatttggcaacttactactgcctaacgtatagtacttattcggtcaccttcggcctaaggggacacggactaggagtaacttaaaacgaactgtcggctgcacatctgtcttcacttccc

SEQ ID NO: 335366 - DNA, 516 bp, Homo sapiens
  misc_feature: GZ8MTXP02G71S8.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcgggccagtcagaatattaatgtgtggctggtatcagcagaaaccagggaaacgcccctatactcctgatccacaaggctctacttagaagtggggtcccatcaaggtcagccggcaatggatctgggacagattcactctcacatcaacagcctgcagcctagatgatttggacaactttacactagcctaaaccgtatagtacttattcggtactaccgtttcgactaacggggacacgaactggggaataacgttaaaacgaactgtacgactcgaacacatctgtcttcatttcccg

SEQ ID NO: 335367 - DNA, 606 bp, Homo sapiens
  misc_feature: GZ8MTXP02JCWWB.22.57.F02.1.454.CMB.2.raw
  modified_base (196)..(196): a, c, t, g, unknown or other
  misc_feature (196)..(196): n is a, c, g, or t
  modified_base (245)..(246): a, c, t, g, unknown or other
  misc_feature (245)..(246): n is a, c, g, or t
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggccagtcagatattatgtggtgctgtannagcagaaacaggaaacncccctatactcctgactccacgaaggctactaagtttaggaaaggtcgggaccagtcgaaggttcaggccgacaagtggatcgtagggacagtaacttcactctaccaacataccaaacncgtccctagaccacggtaccctaggtacttggtactttggaccttaaccttactacgtcgaccctaaacgttattacgttaacttacgttccgtactaccgttacggaccgaaacgggtacaacgtacgtagggaaacgtaaacgtttaaaacggaacgttcggtacggaccgtacggaaccgtaaccctacttccgtcgtttactttacctacgtttccccg

SEQ ID NO: 335368 - DNA, 533 bp, Homo sapiens
  misc_feature: GZ8MTXP02HET8T.22.57.F02.1.454.CMB.2.raw
  modified_base (196)..(196): a, c, t, g, unknown or other
  misc_feature (196)..(196): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggccagtcagaatatatgttggtgctggtatcagcagaaaccgaggaaacgcccctatactctgactaccacaaggctctaacttagaaagtcggggtacccatacgtaaggtcagccggacaagtggatcgtagggacagtaacttcactcacaaccatacaaactacgcctgcagccctagactgtatttacggactaacttactactgacctaacgtatagtacttatcggactacgtcgcaaggcacgacgtacgagtaacgttaaacgaacgtcgtacggctagaactactacttctcgtcttcgacttccc

SEQ ID NO: 335369 - DNA, 536 bp, Homo sapiens
  misc_feature: GZ8MTXP02GCYRZ.22.57.F02.1.454.CMB.2.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (522)..(522): a, c, t, g, unknown or other
  misc_feature (522)..(522): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcgggccagtcagaatattaatagttggtgctggtatcagnagaaacaggaacncccctatactctgactccacaaggcgtctaacgttagaaagtcggggtaccatcgaaggttcaggccggcacgtggatcgtagggacagtaattcaactctacactatacaaacagcctgacagcctagatgtatttgactaacttactactgacctaacgtatacgtacttacgtcggtactacgttcggactaagggacacgacgtaggagtaacgtaaacgactggtacgcttagaactaccattcgtntcttacactttccc

SEQ ID NO: 335370 - DNA, 511 bp, Homo sapiens
  misc_feature: GZ8MTXP02IEWZ3.22.57.F02.1.454.CMB.2.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (461)..(461): a, c, t, g, unknown or other
  misc_feature (461)..(461): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcacatcacttgtcggcagtcagaatataatgttggtgctgtatnagcagaacgaggaacnccctatactcngactcanagctctacttagaagtcgggtaccatacgaaggtcagccggacacgtggatcgtagggaacagtaattcactctacacataccaacacgcctgacacgtcctagatagtattcgactaacttacactcgactaacgtatagtactagtcgtactacgtcgacgaggacacgtactagganaactaacgaacgtcgtacgctcgaacacgtactcgtatcttctactcccg

SEQ ID NO: 335371 - DNA, 561 bp, Homo sapiens
  misc_feature: GZ8MTXP02H54RE.22.57.F02.1.454.CMB.2.raw
  modified_base (194)..(194): a, c, t, g, unknown or other
  misc_feature (194)..(194): n is a, c, g, or t
  modified_base (258)..(258): a, c, t, g, unknown or other
  misc_feature (258)..(258): n is a, c, g, or t
  modified_base (495)..(495): a, c, t, g, unknown or other
  misc_feature (495)..(495): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctccaggtgccaagtgtgacatccagatgacccagtctccttccacctggctgcatctgtagganacagatcacatcacttgcggcagtcagaatatatgttggtgctgatcagcaagaacaggaaacncccctatacctcctagactccaacaaggcgttactaacgtttaaggaaaggttcggggtacccagtaccgaaaggttcaggcccggcacgtggatcgtagggacagtacttcactctcacatacacagcctgcacgcctgatgtattcggactaactactactacgacctaacgtatagttacttacttaccggtactaccgttcggaccgaacgggaccaacgaacgtagggtaanaaacgttaaaacgacgtagtacggactcgaacctactacttcgttacgtccttacgttaccttccc

SEQ ID NO: 335372 - DNA, 603 bp, Homo sapiens
  misc_feature: GZ8MTXP02GQJL2.22.57.F02.1.454.CMB.2.raw
  modified_base (197)..(197): a, c, t, g, unknown or other
  misc_feature (197)..(197): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcacatcacttgcggccagtcagatattaatgttggtgctggtatnagcagaaccaggaacncccctatactctgactccacaggctctaacgtttaaggaaggtcggggtcccagtacgtaaggttcaggccgacacgtggactcgaggactagtaacttcactactaccaccataccaaacgacgtcctgacacgtcctagtactgtacgtttagaccttaacttacctacgtacgtacccgtaacgtattacgttacttacgttccgtacctaccgttacggaccgtaaacggacctaacgtacgtaggtaaacgtaaacgttaaaacggaacgttcggtacggtaccgttacggaacctaccgtacttcgtcgtttaccttacctactttcccccg

SEQ ID NO: 335373 - DNA, 503 bp, Homo sapiens
  misc_feature: GZ8MTXP02GH31C.22.57.F02.1.454.CMB.2.raw
  modified_base (242)..(244): a, c, t, g, unknown or other
  misc_feature (242)..(244): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (354)..(355): a, c, t, g, unknown or other
  misc_feature (354)..(355): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagatatatgtggtgctgnnngcagaacaggaancctancncnatcanagctntacttagaagtgggtccagtcaagtcagccggacacgtggatcgtagggacagtaattcactctaccacataccaacnncctgacagcctagactgtatttgactaacttacactgacctaacgtatacgtacttagttcgtctacgtcggacctagggactacgacgtaggataacgtaaacgacgtcgtacgctgaactaccattctacgtcttacactttcccg

SEQ ID NO: 335374 - DNA, 538 bp, Homo sapiens
  misc_feature: GZ8MTXP02J5UVP.22.57.F02.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
tcagacatacgcgtcacgaccggtgctcgatttagctcgatatagttgggtttgggagtcagaccagtcaggacacagcatggacatgagggtcccgctcagctcctggggctcctgctgctctggctcccaggtgccaagtgtgacatccagatgacccagtctccttccacctggctgcatctgtagagacagatcaccntcacttgcggccagtcagaatatactagttggtgctgtatcagacagaaaccagggtaaacncccctatactctgatccacaacggcgttactaaacgttcgaaacgttagggtccggttaccgntaagttcgacgaccggcgactgaattggacgttcnggaaactcaacttcactcnaccanacggactcncncgcngntntgtagtagtactactactactactactactactactacgtacttacgttacgtacgtacgtacgacgacggacgacgacgtacgacgtacgtaacgtacgtacgtacgtaacgtcgtcgtctactctctactc

SEQ ID NO: 335375 - DNA, 531 bp, Homo sapiens
  misc_feature: GZ8MTXP02JAYFN.22.57.F02.1.454.CMB.2.raw
  modified_base (196)..(196): a, c, t, g, unknown or other
  misc_feature (196)..(196): n is a, c, g, or t
  modified_base (240)..(241): a, c, t, g, unknown or other
  misc_feature (240)..(241): n is a, c, g, or t
  modified_base (243)..(244): a, c, t, g, unknown or other
  misc_feature (243)..(244): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (325)..(325): a, c, t, g, unknown or other
  misc_feature (325)..(325): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggcagtcagatatatgtgtgctgnnannagaacaggaacncccctatacnctgatccanagctntacttagaagtggtccatcagtcagccgcacgtgatcgtaggacngaattcactctcacatacaaacagcctgacacgcctagactgtaagtttcggactaacgttacctactcgaccctaaaccgttattaagtacctttagttccggtactaccgttcgaccgtaagggccaacgactaggaactaaacgtaaaacgacgtagtacggctacgaacctaccctaatctacgttccttactactttcccg

SEQ ID NO: 335376 - DNA, 577 bp, Homo sapiens
  misc_feature: GZ8MTXP02IDNTA.22.57.F02.1.454.CMB.2.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatcgtgtaggagacagagtcaccatcacttggcgggccagtcaagaatattaatgttggttgctgtatcagcagaaacaggaaacgcccctatacctcctgactccacaaggctctactttagaaaggtgggtacccatcaaggttcagcccggacacgtggatcgtggacagtacttcactctcaccatacaaacagccctgcagcctgatgtatttcgactaacttactacctgaccctaacgtagttacgttaccttaacgttccggtacctaccgttacgggaccgaacgggacgaacgtaacgtaggacgtaaacgtttaaaacggaacgttcgtacggtcttacggccgtaaccctaagttcctcgttccttacgactttcccg

SEQ ID NO: 335377 - DNA, 584 bp, Homo sapiens
  misc_feature: GZ8MTXP02I7HMD.22.57.F02.1.454.CMB.2.raw
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggcagtcagatattaatgtgtgctggtatcagnagaacaggaacncccctatactcctgatccanaagctactacttagaaagtgggtaccatcaaggttcagccggcactggatcgtgggacngaattcactctcacatacaacngccctgacagcctagactgtatttgactaacttactactcgaccctaaacgtatagttacttacgttccggtactaccgttcggacctaaaggggacaacggtacgtagggtaaacgtaaacgtttaaaaaccggaaacgttgggtaacggtccgttacggtaacccgacccgtaactttacccggttcgtttaaccctttccgtaactttttcccccgg

SEQ ID NO: 335378 - DNA, 597 bp, Homo sapiens
  misc_feature: GZ8MTXP02GAQ6J.22.57.F02.1.454.CMB.2.raw
  modified_base (195)..(195): a, c, t, g, unknown or other
  misc_feature (195)..(195): n is a, c, g, or t
  modified_base (409)..(409): a, c, t, g, unknown or other
  misc_feature (409)..(409): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatcgaccagtctccttccacctggctgcatctgtagganacagatcaccatcacttgcggcagtcagaatattatagttggtgctgtatcagcagaaaccgaggaaacgcccctatactctgactaccacaaggcttacttaacgtttaaggaaaacggttcggggtaccccaagtaccgtaaaggttcgaggacccggacaaagtggatcggtgggaacaggtaattcacttcctaccaaccataccaaacncgcctgacacgtccctagatgtattcggactaacttactactcgacctaacgttatagttacttagtccgtactaccgttacggaccgaagggacacggacgtaggaacgtaaacgttaaaacgacgtcggtacgacttacggaaccgtaacctacgttacgttcgttaccttaccgtactttccccg

SEQ ID NO: 335379 - DNA, 597 bp, Homo sapiens
  misc_feature: GZ8MTXP02JLT8G.22.57.F02.1.454.CMB.2.raw
  modified_base (335)..(335): a, c, t, g, unknown or other
  misc_feature (335)..(335): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggctggtatcagcagaaacaggaaacgcccctatactcctgatccacaaggctactacttagaaagtggggtccatcaaggtcagccggnaatggatcgtagggacaggaattcactctacaccatcaaacagcctgcagccctagactgtagtttggacctaaactttactactcgaccctaaccgttatagttaactttacgttccggtactacccgtttacggaccctaaaggggtaccaacggtaacgtaggggaaacgtaaacgtttaaaaaccggaactttacgggtacggtactacggaaccgaaccctaacggtccttcggttacctttccgtaactttccccg

SEQ ID NO: 335380 - DNA, 533 bp, Homo sapiens
  misc_feature: GZ8MTXP02G0WJ1.22.57.F02.1.454.CMB.2.raw
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattatagttggtgctggtatcagcagaaaccaggaaacncccctatactcctgatccanaaggctctacttagaaagtcgggtacccatcgaaggtcagccggcacgtggatcgtgggacagtaattcactctacaccatcaacacgcctgcagcctgatgtatttggactaacttactacgtcgaccctaacgtattagttacttagttccggtactaccgtcggaccaagggacacgacgtaggagtaacgttaaacgaacgtgtacggctagctaccatcttgtccttcgactttcccg

SEQ ID NO: 335381 - DNA, 584 bp, Homo sapiens
  misc_feature: GZ8MTXP02JFM0V.22.57.F02.1.454.CMB.2.raw
  modified_base (248)..(248): a, c, t, g, unknown or other
  misc_feature (248)..(248): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcggcagtcagaatattaatgttggtgctggtatnagcagaaacaggaaacgcccctatactctgatccacaaggtctactacgttaagaaagttcggggtacccatcgaaggttcacggccggcacgtggtactcgtagggactaggtaacttcaactcctacaacctactaccgaaacacgccctagaccagccgtagactaggtagtttcgactaactttacctactacgaccctaacgtattacgttacttacgttcgtacctaccgttacggaccaacgggtaccaacggtacctagggaaacgtaacgttaaaacgaacgtcggtacggtcttagccaacctatctagttccttacactttcccg

SEQ ID NO: 335382 - DNA, 509 bp, Homo sapiens
  misc_feature: GZ8MTXP02IR4GJ.22.57.F02.1.454.CMB.2.raw
  modified_base (197)..(197): a, c, t, g, unknown or other
  misc_feature (197)..(197): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctgtctgcatctgtagganacagagtcaccatcacttgcggcagtcagaatattatgttgtgctggtatnagcagaacaggaacnccctatactctgatccacagctctacttagaaagtgggtccatcaaggttcagccgcactgatcgtggacngattcactctcacatcangctncngctgatgatttgactaacttacacttcgacctaacgtattagtacttagttccggtctaccgttcggaccaaagggacacgacgtaggaagtacttaaaacgacgtgtacggctgaacctaaccattaccttagtcctttacactttcccg

SEQ ID NO: 335383 - DNA, 579 bp, Homo sapiens
  misc_feature: GZ8MTXP02IHP4J.22.57.F02.1.454.CMB.2.raw
  modified_base (195)..(195): a, c, t, g, unknown or other
  misc_feature (195)..(195): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtagganacagagtcaccatcacttgtcgggcagtcagaatattaatagttggtgctgtatcagcagaaacaggaacgccctatactcngatcanagctctattagaagtggtccatacagtcagcgacaagtggatcgtaggacagtaattcacttcaccacatacaaactagccctagacacgacctagaacgttagtaacgtttcggaccttaaaactttaaccgttaactaccgtacccttaaaacgtatttaacgttactttacgttaccggtacctacccgttacggaaccgaagggtaaccgaaccggtacgtaaggaaggtaaaacttaaaacggaaacttggtacgtctagaactacgacttcgtacttcttctacttcccg

SEQ ID NO: 335384 - DNA, 591 bp, Homo sapiens
  misc_feature: GZ8MTXP02I8CI7.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggcggccagtcagaatataatgtggtgctggtatcagcagaaaccaggaaacgcccctatactcctgactccacaaggcgtctaacgttagaaaggtgggtaccatacgaaggttcaggccggacaagtggatcgtagggacagtaacttcactctacacatacaaacagcctgcagcctagactagatttggactaacttactactcgaccctaacgtacttagtaacttagttaccggtaccaccgtttaccggacgtaaacggggacctacggtaacgtagggtaaacgtaaacgttaaaacggaacgttacggtacgggtaccgttacggaacctacccgtattcccgtagttccttacgttaactttccccg

SEQ ID NO: 335385 - DNA, 547 bp, Homo sapiens
  misc_feature: GZ8MTXP02IY07W.22.57.F02.1.454.CMB.2.raw
  modified_base (197)..(197): a, c, t, g, unknown or other
  misc_feature (197)..(197): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctccttccaccctggctgcatctgtagganacagagtcaccatcacttgcggccagtcagaatattaatgttggtgctggtatcagcagaaacaggaaacgcccctatacctctgactccacaaggcgtactactttagaaagtgggtcccatcgaaggttcagccggcacgtggatcgtggggaacaggaattcactctacaccatcaaacagccctagcagccctgatgtatttcggactaaacttactactcgaccctaaaccgtatacgttacttacgttcgtcaccgttcggacctaagggacacgactggaacgtaacgttaaacgaacgttgtacggtctgaacctaaccattctcgttacttcactttcccg

SEQ ID NO: 335386 - DNA, 526 bp, Homo sapiens
  misc_feature: GZ8MTXP02GY01I.22.57.F02.1.454.CMB.2.raw
  modified_base (195)..(195): a, c, t, g, unknown or other
  misc_feature (195)..(195): n is a, c, g, or t
  modified_base (343)..(343): a, c, t, g, unknown or other
  misc_feature (343)..(343): n is a, c, g, or t
tcagacatacgcgtcacgaccggtgctcgatttagctcgatatagttgggtttggggagtcagacccattcaggacacagcatggacatgagggtccccgctcagctcctggggctcctgctgctctggctccaggtgccaagtgtgacatccagatgacccagtctccttccaccctggctgcatctgtagganacagagtcaccatcacttgcggccagtcagaatataatagtggtgctggtatcagcagaaaccaggaaagcccctatactcctgatccacaaggctctacttagaaagtgggtccatcaaggttcagccggcacgtgatcgtgggacngaattcactctcacatcaacacgcctgcagccctagactgtatttggactaaacttactactgacctaacgtatagtactttatcggtactaccgttcggacctaagggacacgtactaggaagtaacttaaacgaactgtacggacctagaaccgtaccattctcgttcttacactttcccg

SEQ ID NO: 335387 - DNA, 550 bp, Homo sapiens
  misc_feature: GZ8MTXP02IT1SL.22.57.F02.1.454.CMB.2.raw
  modified_base (270)..(270): a, c, t, g, unknown or other
  misc_feature (270)..(270): n is a, c, g, or t
  modified_base (440)..(440): a, c, t, g, unknown or other
  misc_feature (440)..(440): n is a, c, g, or t
  modified_base (535)..(535): a, c, t, g, unknown or other
  misc_feature (535)..(535): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctcccttccaccctggctgcatctgtaggagacagagtcaccatcacttgtccgggcagtcagtaatattaatgttggtgctggtatcagcagaacaggaaacnccctatactcctgactccacaacggcgttacttacgttaagaaaacggttcggggtaccctagtacgaaggttcacggccggacacgtggactcgtagggacagtaattcacttcctacacactacaacagacctgcacgctagtactgtattcgactaacttactactnacctacgtatagtacttacgtcgtactcgtacggacgaagacacgtacgtaggataaacgttaaacgacgtgtacgtacgtcaacacgtactctntcttactacttcccg

SEQ ID NO: 335388 - DNA, 513 bp, Homo sapiens
  misc_feature: GZ8MTXP02HXRYY.22.57.F02.1.454.CMB.2.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctccaggtgccaagtgtgacatccagatgacccagtctccttcacctggctgcatctgtagganacagagtcacatcattgcggcagtcagaatatatagttggtgctgancagcagaaaccaggaacnccctatactctgatccacaaggcgtctaacttagaaagtgggtaccatacaagtcagccggcactggatctgggacngaaattcacttcacaccatacaaanagactcncacgctgatagattaggtactaacttactactacgtactaacgtaactagtacttattacgtactacttacgaccgaacggacgacgacgtagagaataaacgaacgtacgtagcgcgaacgaccatactcgtcttactacttccc

SEQ ID NO: 335389 - DNA, 593 bp, Homo sapiens
  misc_feature: GZ8MTXP02GKVTW.22.57.F02.1.454.CMB.2.raw
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (359)..(359): a, c, t, g, unknown or other
  misc_feature (359)..(359): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatattaatgttggtgctggtatcagcagaaaccaggaaacncccctatacnctgatccanagctactattagaaagtcggccatcagtcagccgcactgatcgaggacagattcactcctcaacatacaaacngcctgcacgcctagattgagtttggactaaaccttactacgtacgaccctaaacgttattaacgttaacgttactttccgggtacctacccgtttacggaccgtaaacggggaaccaacggtaaccggtagggaaacgtaaaacgtttaaaacggaaacgttaggtacgggtaccgttacggaaccgtaaacctactttaccggttacgtttcctttaccgtacgtttcccccg

SEQ ID NO: 335390 - DNA, 601 bp, Homo sapiens
  misc_feature: GZ8MTXP02HY73Z.22.57.F02.1.454.CMB.2.raw
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagatatatgttgtgctggatcagcagaaacaggaaacnccctatacncctgactccanaaggctacttacttaggaaagttcggggtacccatacgtaaggtcagccggcagtggatcgaggaacngtaacttcacttcctacactatacaaacgngcctagcacgcttagacgttgtaacttacggactaaactttacctacgttacgaacccgttaaacgttattaacgttacctttacgtccggtacctaaccggttacggaaccgaaacggggtacaacgggtaactaggggtaaacttaaacgttaaaaccggtaacgttgggtacgtactacggccgtaactacgttcgtactaccttacttacgttcccg

SEQ ID NO: 335391 - DNA, 534 bp, Homo sapiens
  misc_feature: GZ8MTXP02GDD1B.22.57.F02.1.454.CMB.2.raw
  modified_base (286)..(286): a, c, t, g, unknown or other
  misc_feature (286)..(286): n is a, c, g, or t
  modified_base (333)..(333): a, c, t, g, unknown or other
  misc_feature (333)..(333): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatattaatagtggtgctgtatcagcagaaacgaggaaacgcccctatactcctgatccanaaggctactactttagaaagtgggtccatcaggtcagcgcaatgatnaggacagaattcaactctacaccatacaacagacctgactagcctagatagatttaggactaaacttactacttacgacctaaccgttatacttacttagttaccggtctaacccgttcggacccgaaggacaacgactaggactaaagtaaaaccgaagtcgtgcgtacgcgaacacttcctgtaccttactactttccc

SEQ ID NO: 335392 - DNA, 625 bp, Homo sapiens
  misc_feature: GZ8MTXP02INAGP.22.57.F02.1.454.CMB.2.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (433)..(433): a, c, t, g, unknown or other
  misc_feature (433)..(433): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgcggccagtcagatattatgttggtgctgtancagcagaaacaggaaacncccctatactctgataccanaaggcgtctaacgttagaaaagggttcgggtacccagtcgaaaggttcacggccggacacgttgggaactcgtaggggaacctaggaactttccgaaccttcctaccaaccacttaccaaacgtacgaccctgaccacggtcccttagngttagtagtttacggactaaactttactacgtacgacccgtaacttagtaacgttaactttagttccggtaccttaccggttaccggacctaaacggggactaaacggtacgtaggaaagtaaacgtttaaaacgacgttagtcgggtactacggaacctaacctagttcctgttaccttactacttccccg

SEQ ID NO: 335393 - DNA, 568 bp, Homo sapiens
  misc_feature: GZ8MTXP02GHRHE.22.57.F02.1.454.CMB.2.raw
  modified_base (275)..(275): a, c, t, g, unknown or other
  misc_feature (275)..(275): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcaagaatattaagtagttggttggctggtatcagcagaaaccgaggaaacnccctatactcctagactccaagaggctactaacgtttaagaaaggtcgggtaccatagtaagtcagccgacacgtgatcgtaggacagtacttcactcctacacataccaaactagcctgacacgcctagntcgtagttcgactaactactacncgacctaacgtattaacgtacttacgtcgtacctacgtcggaccaagggaccaacggtacgtagggaaattaaaccgttaaaacgacgttacgtacggctacgaaccgtaactacttcgtcttacttctacctttcccg

SEQ ID NO: 335394 - DNA, 599 bp, Homo sapiens
  misc_feature: GZ8MTXP02I7J02.22.57.F02.1.454.CMB.2.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (348)..(348): a, c, t, g, unknown or other
  misc_feature (348)..(348): n is a, c, g, or t
  modified_base (580)..(580): a, c, t, g, unknown or other
  misc_feature (580)..(580): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccacctggctgcatctgtagganacagatcaccatcacttgcggcagtcagatataatgtggtgctgatcancagaacgaggaacnccctatactcctgactccanaaggctactacttaagaaagtcgggtaccatacgaaggttcagcccggtcacgtggatcgtagggaacngtaacttcactctacacatcaaactgcctgacagtccctagtactagtagtttacggactaaacgttttacaccttacgaaccccgttaaacgttacttaacggtttaacctttacgtttacccggtacttaacccggtttccggacccgtaaaggggtacctaacgggtactaggggaaactaaacgttaaaacgacgttagttacggctacgaactaccgactttacgtntcctttactactttccccg

SEQ ID NO: 335395 - DNA, 562 bp, Homo sapiens
  misc_feature: GZ8MTXP02JZ26A.22.57.F02.1.454.CMB.2.raw
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
  modified_base (544)..(544): a, c, t, g, unknown or other
  misc_feature (544)..(544): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggccagtcagaatattaatagttggtgctggtatcagcagaaacgaggaaacncccctatactcctgactaccanaaggctacttaatttaaggaaaggtcgggtacccagtacctaaggttcaaggcccggactacgtggtatcgtaggggaactagtaaacttccactctaccaacctataccgaaacacgcctacgacacgtcctgactgtatttcggacttaaacttactactcgacctaacgttatagttacttagttccgtactaccgtcgaccgaaggcaacgtacgagataactaaacgactgtcgacttcgctaaccntctgtacttcacttcccg

SEQ ID NO: 335396 - DNA, 676 bp, Homo sapiens
  misc_feature: GZ8MTXP02HYX6P.22.57.F02.1.454.CMB.2.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctggtaggagacagagtcaccatcacgttggtcgggccagtcagtaatattaatggttggtgctggatnagcaagaaacgaggaacncccctatacctccngactccacgaaggtctacttaacgttaaggaaaggtcgggtacccagtacgtaaggtcagcccggacacgtgatcgagggaacngtattcactcctacaccataccaacncgtcctacgacacgtcccgtagacgttggtacgtttacggtaccttaaacgtttaacctaccggttacgtaaccccgttaaacgttaacttaacgttaccctttaacgttacccggttacccttaacccggttccgggaaacccggtaacggggtaaaccgtaacccggtaacggtaacgggtaaacggtaaaacgtttaaaaccggtaacgttcgggtacgtaccgttcgaaccgtactactttcgtacgtttccctttaacgtccgttacccccg

SEQ ID NO: 335397 - DNA, 589 bp, Homo sapiens
  misc_feature: GZ8MTXP02FLZS9.22.57.F02.1.454.CMB.2.raw
  modified_base (397)..(397): a, c, t, g, unknown or other
  misc_feature (397)..(397): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttgcggcagtcagaatattaatagttggtgctggtatcagcagaaaccaggaaacgcccctatactcctgactaccacgaaggcttacttaacgtttaaggaaaaggtcggggtacccagtacgtaaggttcaggccggcacgtggatcgtagggacagattcactctacaccataccaaacncgtaccctgacagccgtagattagtacgtttagactaactttactactacgaccaacgttatagttacttacgttcggtactaccgttcgaccgaagggacacggtaactagggaataaacgtaaaacggtaacgtggttacgacgttacgaacgtaaccctagttcctacgttaccttcctactttccccg

SEQ ID NO: 335398 - DNA, 609 bp, Homo sapiens
  misc_feature: GZ8MTXP02HAY3B.22.57.F02.1.454.CMB.2.raw
  modified_base (197)..(197): a, c, t, g, unknown or other
  misc_feature (197)..(197): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcggccagtcagtaatattaatagttggttgcctggtatcagcaagaaaccgaggaaacgacccctatacctcctgactaccacgaaggtccgtactaacgtttaaggaaaggttcggggtaccagtacgaagttcaggccggcagtgatcgaggacngtattcactcacaccatacaaacgacncctagcacgcctgtactgtacgtttgaacctaactttaactactacgtaccctaaacgttacttacgttaactttacgttaccggtactacccgttcggaccgtaaagggaccacggtacgtacggaaataaacgttaaaacggaactttagggacgtacgtacgaaccgtacctacttacttaccgtctttcctaacgtttcccccg

SEQ ID NO: 335399 - DNA, 575 bp, Homo sapiens
  misc_feature: GZ8MTXP02IN3DU.22.57.F02.1.454.CMB.2.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctccttccaccctggctgcatctgtagganacagagtcaccatcacgttgtccgggcagtacagtaatattaatagttggtgctgtatcagcaagaaaccgaaggaaacgtccctaatacctcctagactaccaacgaaggtcttctaacgttaagaaaggtcggtaccatacgagtcagccgctagtgatcgaggangtatcactctccacatacaancgctgcagtcctgattgtagttcgacttaacgttctaccgtacgtacccttaacgttattacggttacttaacgtccgtaccgttaccgttcgggaccgtaaacggggtacacccggtacgttaggaaagtaacgttaaacgactgggtacgtctagcaactcttactcgttaccttcactttaccccg

SEQ ID NO: 335400 - DNA, 527 bp, Homo sapiens
  misc_feature: GZ8MTXP02HFAUK.22.57.F02.1.454.CMB.2.raw
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggtcggccagtcagaatattaatgttggtgctggatcagcagaaacaggaaacnccctanactctnactccanagctntattagaagtcggtccatcagtcagccgnatgatcgtaggacngacttcactctcacatcaacngcctgcagcctgatagtntttcgactaacttacactcgacctaacgtatacgtacttacgtcgtactaccgttcgacgtaggactacgtacgtaggacgtaaacttaaacggaacttcgtacggacttaggaaccgtaactacgttctagttaccttactaactttccccg

SEQ ID NO: 335401 - DNA, 554 bp, Homo sapiens
  misc_feature: GZ8MTXP02JBIEA.22.57.F02.1.454.CMB.2.raw
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (547)..(547): a, c, t, g, unknown or other
  misc_feature (547)..(547): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttggccgggcagtcagaatattaagtgttggtgctggtancagcaagaaccagggaacncccctatactctgactaccanaggtctactaacgttagaaaggtcgggtacccagtctaaggtcaggcccggacacgtggactcggaggacagtactcactctacacctancaaacncgcctgcagctagatgtatttcggacttaacttactactcgtacctaacgttattacgttacttacgttcgtacctacgttcggaccgtaagggacacggactacgggaataaacgttaaaccggaagttcgcgcttagcaccgtatctgtccttacnctttccc

SEQ ID NO: 335402 - DNA, 498 bp, Homo sapiens
  misc_feature: GZ8MTXP02GN826.22.57.F02.1.454.CMB.2.raw
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
  modified_base (456)..(456): a, c, t, g, unknown or other
  misc_feature (456)..(456): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttgcggcagtcagaatatatgtgtgctggntcagcagaaacaggaaacgccctatactcctgactccacaaggcgtactactttagaaagtggggtcccatcaaggttcagccggcactgatcgtggacagaattcactctcacatcaaacngcctgcagccctgactgtattggactaacttacactcgacctaacgtatagtacttattcgtctacgttcggacaaggacacgactggaanaacttaaacgactgtcgctagcacatctagtctcacttcccg

SEQ ID NO: 335403 - DNA, 578 bp, Homo sapiens
  misc_feature: GZ8MTXP02FWA6K.22.57.F02.1.454.CMB.2.raw
  modified_base (281)..(281): a, c, t, g, unknown or other
  misc_feature (281)..(281): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggtgcctggtatcagcaagaacaggaaacgcccctatacncctgactcacaggctactacttagaaagtcgggtccatcaaggtcagccgcactggatcgngganagaattcgactctacacatacaanacgcctagcagcctagatagtattggactacttaanctagtacctaaacgttattaacgttacttacgttcggtactaccgttacggaccgtaaacgggtcacgtaacgtacgggaaacgtaaacgttaaaaccggacgttacgggttacgaccgttacggaacccttaccgtaacgttcgtacgtttacttacctaccgtttccccg

SEQ ID NO: 335404 - DNA, 606 bp, Homo sapiens
  misc_feature: GZ8MTXP02HFYOW.22.57.F02.1.454.CMB.2.raw
  modified_base (199)..(199): a, c, t, g, unknown or other
  misc_feature (199)..(199): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctggtagganacagagtcacatcacttgcgggcagtcaagaatattaatgttggtgctggtancagcagaaacaggaacnccctatacctctnactccacaacggtcgtacttaagttaggaaaggttcggggtaccagtacgtaaggttcaaggcccggacacgtggactcgtacgggactagtaacttcacctctacacatacaaactcgcctgcacgcctgattgtattggactaaccttactactacgaccctaagtattacgttaccttagttacccggtacctaccggttccggaaccggtaaacgggaccgtaaccggtaggttacgggtaaagtaaaccgttaaaacggtacgttggtacggtacctcggtaaccactacttccgttcgtacctttacctacttccccc

SEQ ID NO: 335405 - DNA, 591 bp, Homo sapiens
  misc_feature: GZ8MTXP02JFNX2.22.57.F02.1.454.CMB.2.raw
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagatattaatgttgtggctggtatcagcagaaacaggaaagcccctatactcctgatccaacaaggcgtactactttagaaagtggggtccagtcaaggttcaggccggcaaagtcgggaatcgtaggggacagaatttcaactcctcgaccatcaaaaccncgacctgcncgctagactgtatttcgactaacttactactacgaccctaacgttattacgttactttacgttaccggtaccttaccgtccggtaaccgaacggggaccaacggtaacgtagggtaacgttaaacgttaaaacggtaacgtacggtacggctacgaaccgtacctacgttcttacgttacttacgtaccgtttcccg

SEQ ID NO: 335406 - DNA, 643 bp, Homo sapiens
  misc_feature: GZ8MTXP02HCFDK.22.57.F02.1.454.CMB.2.raw
  modified_base (248)..(249): a, c, t, g, unknown or other
  misc_feature (248)..(249): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (397)..(397): a, c, t, g, unknown or other
  misc_feature (397)..(397): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggtcggccagtcaagaatataatgttgtgctgannagnagaaacgaggaacnccctatactctgactccaatacggctacttaagttaagaaaggtcgggtaccagtacgaaggttcaggcccggactaaagtggactcgtaggggaactaggaacttcgactacctacaccaataccaaacncgacctgacgacgccgtagtatacgtacgtttacggaacttaacctttacgtaccgtacggtaaccctaaacgttaattacggttaacctttaacgttccggtacctacccggttaccgggaacccggtaaacggggtaccaaccgggtaaacggtacggtaaaacgttaaacgttaaaaccggtacgttagggtacggtactacgaacctaacgtacttcgtcgtttacctaccgtcctttcccg

SEQ ID NO: 335407 - DNA, 583 bp, Homo sapiens
  misc_feature: GZ8MTXP02GPC7E.22.57.F02.1.454.CMB.2.raw
  modified_base (386)..(386): a, c, t, g, unknown or other
  misc_feature (386)..(386): n is a, c, g, or t
tcagacatacgcgtcacgaccggtgctcgatttagctcgatatagttgggtttgggagtcagacccagtcaggacacagcatggacatgagggtccccgctcagctcctggggctcctgctgctctggctcccaggtgccaagtgtgacatccagatgacccagtctccttccaccctggctgcactctgtaggagacagagtcaccatcacttgtcgggcagtcagtaatattaatgtggtgctgtatcagcaagaaaccagggaaacgccccctaagtacctcctcgactcccaacaaggctcttaacttaagaaacgtggggtacccatcgaaggttcagccggcacgtgactcgtgggacagtatcactctcacatcaaacngcctgcacgcctagactgaatttggactaactttacactacgtaccctaaaccgtattaacggttaccttaacgttccgtaccttaaccgttccggaccgaaaggggtaccaaccggtaagtacggaaagtaaacgtttaaaacggaacttggtaacggcctaggaaccaacgtatccgtcgtcttacactttcccg

SEQ ID NO: 335408 - DNA, 623 bp, Homo sapiens
  misc_feature: GZ8MTXP02H9K5J.22.57.F02.1.454.CMB.2.raw
  modified_base (198)..(198): a, c, t, g, unknown or other
  misc_feature (198)..(198): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (422)..(422): a, c, t, g, unknown or other
  misc_feature (422)..(422): n is a, c, g, or t
  modified_base (607)..(607): a, c, t, g, unknown or other
  misc_feature (607)..(607): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctcccttccaccctggctgcatctgtagganacagacgtcaccatctacgttcggtcgggccagtcaagtaattattaagtaggttggtggcctggtancagacaacgaaacgaggaaacgccctatacctcngactccacaacggtcgttacttaacgtttaagaaaggtcgggtaccagtacgtaaggttcaggcccgacacgtggactcgtagggaacagtaacttcacttctaccaaccataccgaaaccncgacctgacgacgcgtagtagtacgttacgttacgacttaacttacgtactaccgtaaccgtaacgttagttaacgttacgttacgttaccggtacgtaccgtacggaaccgaacggacaacgtacgtaggtaaactaaacgttaaacgacgtacgtacgtacgacgtaacctacgtactcgttntacttacgaccttccg

SEQ ID NO: 335409 - DNA, 572 bp, Homo sapiens
  misc_feature: GZ8MTXP02H6N4T.22.57.F02.1.454.CMB.2.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
tcagacatacgcgtcacgaccggtgctcgatttagctcgatatagttgggtttgggagtcagacccagtcaggacacagcatggacatgagggtccccgctcagctcctggggctcctgctgctctggctcccaggtgccaagtgtgacatccagatgacccagtctccttcacctggctgcatctgtagganacagagtcaaccatnacttgtcgggaccagtcaagtaatattaatagttggtagcctggtatcagcaagaaacaggaancccctataccnctagatcacaaggctctaattagaaagtgggtaccatctaaggtcagcgacaaatggatctagggacagaattcactacctacaccgatcaacagccagcagctgatgacttagctaaactacgtatgaccgtaaactatagttaacgttattacggactaccctttaacgggccaaaagggaccaacggttaacctaacggaggtaaacttaaaaacggaaaccgttagacccggttcgtaacgaaccgtaaacctaacgtccgttactaccttacgttaacctcccg

SEQ ID NO: 335410 - DNA, 610 bp, Homo sapiens
  misc_feature: GZ8MTXP02I907J.22.57.F02.1.454.CMB.2.raw
  modified_base (193)..(193): a, c, t, g, unknown or other
  misc_feature (193)..(193): n is a, c, g, or t
  modified_base (244)..(244): a, c, t, g, unknown or other
  misc_feature (244)..(244): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctccaggtgccaagtgtgacatccagatgacccagtctccttcacctggctgcatctgtagganacagagtcaccatcacttgcggccagtcagatattaatgtgtgctggtatnagcagaaaccaggaaacgccctaatacctctagatccacaaggctctaacgtttaagaaacgtcggggtacctagtacgtaaggttcaacggccgtacgacgtggtaactcgtaggggacaggtaattccgactactccaaccatccgaaacacgccctagacacgtcccgtgagtagtacgtttacggactaacttaacgtacgtaccgaaccgttaaacgttacgtaacgtttaaccttacgttaccggtactacccgtttacggaccgtaaggggtaccaacggtaccgtgggtaaaataccgtaaaagacgttacggtcgcttacggaactacgtactacgtactctacctacgtttccccg

SEQ ID NO: 335411 - DNA, 511 bp, Homo sapiens
  misc_feature: GZ8MTXP02I5G80.22.57.F02.1.454.CMB.2.raw
  modified_base (252)..(253): a, c, t, g, unknown or other
  misc_feature (252)..(253): n is a, c, g, or t
  modified_base (255)..(256): a, c, t, g, unknown or other
  misc_feature (255)..(256): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctcccttccaccctggctgcatctgtaggagacagagtcaccatctacttggtccggcagtcagtaatataagtgtggtgctgtnnannagaacaggaacncctanacnctnactcacagctactattagaagtcggtccagtacagtcagccgacagtagatcgtaggactagtactacgactcctacaactatacaactgcctgcacgctagactagtattgactaacttactactcgactactatatacttacgtcgactcgtacggactaggactagactggaataacgtaaacgacgttgacggtactacgaactacctatcgtactctactcttaccc

SEQ ID NO: 335412 - DNA, 534 bp, Homo sapiens
  misc_feature: GZ8MTXP02FNZL8.22.57.F02.1.454.CMB.2.raw
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgcgggcagtcagaatataatgttggtgctggtatcagcagaaacaggaaacgcccctatacnctgatccanaaggctctacttagaaagtggggaccagtcaaggttcaggccggacacgtggatcgtggggaacagatcaactctacacatacaacagcctagcacgcctagatgtatttacggacttaaacttaactacgtacaccctaaacgttattaacgtaacttacgttcggtactaccgttcggaccaaggggacacgacgtaggaagaattaaaacgactggtagctgaacacattcctatctacacttccc

SEQ ID NO: 335413 - DNA, 597 bp, Homo sapiens
  misc_feature: GZ8MTXP02GL2BO.22.57.F02.1.454.CMB.2.raw
  modified_base (420)..(420): a, c, t, g, unknown or other
  misc_feature (420)..(420): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatcgtggtaggagacagagtccaccatcacgttggtccgggccagtcaagtaattattaagtaggttggttggccttggtatcagacaagaaaccgaggaaacgcccctatacctcctgactccaacgaaggtcctacttaactttaaggaaaggtcggggtacccagtacgtaaggttcacgccggactacgtggatcgtagggacagtactcactctaccacactacaacncgcctgacacgcctgattgtagttcggacctaacgttacactacgaccctaacgtatagttacttacgttccgtactaccgtcggaccaaggggacctaacggacgtagggaaataacttaaaacggacgttcgacgtcctgcctacctacgttcttcgtacttcgtactttccccg

SEQ ID NO: 335414 - DNA, 640 bp, Homo sapiens
  misc_feature: GZ8MTXP02F2FGU.22.57.F02.1.454.CMB.2.raw
  modified_base (274)..(274): a, c, t, g, unknown or other
  misc_feature (274)..(274): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctccttccaccctggctgcatctggtaggagacagagtcaccatcacttggtccggccagtcagaattattaagtgttggtggctggatcagcaagaaccaggaacnccctatactcctagactccaagagtcgtacttaacgttaaggaaacggtcggggtaccagtacgaaggttcaggccgacaagtggatcgtagggaacagtaattccgactcctaccactatacccaaactacgccctagaccagtcccgttagattacggtatttacggacctaacgtttacctacgtaccgtacccgtaaacgtttacttaacgttacgtttaaccgttccgggtaccctacccggtttaccgggaaaccgaacggggtacccaacggtaccgtagggtaaacgtaaacgtaaaaccgtacgtgttacggctacggcctaaccgtattccttacggttactccgtactttccccg

SEQ ID NO: 335415 - DNA, 784 bp, Homo sapiens
  misc_feature: GZ8MTXP02HLY7D.22.57.F02.1.454.CMB.2.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagtatgacccagtctcccttccaccctggctgcatctgtaggagacagagtcacatcacttgcggccagtcagaatatatgttggtgctgtancancagaaacgaggaacncccctatacctctgactaccaagaacggtcgtacttaacgtttaaaggtaaaacgggttccggggttacccctaaagttaccgtaaacggggtttcgaacggcccccggtaccgtaaccgttggggaaactttccggtaaggggtaaaccctaagggttaaaccctttttaccaaacccgttccccttaaaccctaaaccccgtaaacttaacccgaaaacccgtacccggtaccccgtttacgggacccaccgtacccgttaggttaaccgttagttaacgttttacgggaccttaaaacctttacccttaaccgttaccgaaaacccccgtttaaaccgtttaagttaaccgtttaacgtttaccgtttaccgggtacccttaccccggtttacgggaacccgttaaacggggaccgtaaccggtaacgtacgggtaaagtaaacttaaaaccggtaacgtggtacgtacgttacgaacctactacgttacgtctttacctacgtacctttccccg

SEQ ID NO: 335416 - DNA, 603 bp, Homo sapiens
  misc_feature: GZ8MTXP02GZ0HU.22.57.F02.1.454.CMB.2.raw
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatgttggtgctggtatcagcagaaaccaggaaacgcccctaatacctcctagactccacaacggctactaacgtttagaaaggtcggggtacccatcgaaggttcacgccggacacgtggatcgtagggacagtaaattcgactctacacatacaacagcctagcagcctgatgtattgacctaacttactacgtcgaaccctaaacgtattaacggttacctttagtttaccggtaccctaccgttaccgggaccgtaaacgggacctaaccgtaacgtaccggaaagtaaactttaaaaccggacttacggtacggcttacggaacctaccaacgtttcctcgttacctttccgaactttcccccg

SEQ ID NO: 335417 - DNA, 593 bp, Homo sapiens
  misc_feature: GZ8MTXP02IYH0U.22.57.F02.1.454.CMB.2.raw
  modified_base (362)..(362): a, c, t, g, unknown or other
  misc_feature (362)..(362): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcattgtcgggccagtcagaattattaatagttggttggcctggtatcagcagaaaccagggaaacgcccctatacctcctgatccacaagcgtctaactttagaaaagtcggggtaccatacaaggttcagccggcacgtggatcgtgggaacngaattcactctcaccatcaacagcctagcacgcctgatgtaattcgactaacttactactagacctaacgtattacgtaacttacgttcggtacaccgtttacgaccgaaagggactacgtaaccgttaggaagtaaacgtttaaaaccgaaacgtttggtaaacgggccctttaaggaacccgtaaccgtaagttacccgtttacgttacccttacgttacctttacccg

SEQ ID NO: 335418 - DNA, 559 bp, Homo sapiens
  misc_feature: GZ8MTXP02HY6AI.22.57.F02.1.454.CMB.2.raw
  modified_base (269)..(269): a, c, t, g, unknown or other
  misc_feature (269)..(269): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcggcagtcagaatattaatagttggtggctggtatcagcagaaaccaggaaacncccctatacctctgactccacacggctacttacgttagaaagtcggggtccatcgaacggttcaacgccggacacgtggactcgtggggaacaggtaaactttcaccttactaccaccaatacaaacagccctgaccacgccctgaacttggtatttcggactaacttactactacgacctaacgtatacgtacttacgttcgtactaccgttcggaccgtaaggacaacgtacgtaggaataactaaacgactgtacgctagaactacagtctacgtctactacttccc

SEQ ID NO: 335419 - DNA, 680 bp, Homo sapiens
  misc_feature: GZ8MTXP02JEH0X.22.57.F02.1.454.CMB.2.raw
  modified_base (197)..(197): a, c, t, g, unknown or other
  misc_feature (197)..(197): n is a, c, g, or t
  modified_base (459)..(459): a, c, t, g, unknown or other
  misc_feature (459)..(459): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtcctccttccaccctggctgcatctgtagganacagagtcaccatctacgttggtcggccagtacaagtaattaataagttggttggttcggtccttaggtatacagacaagaaaccgaagggaaacgacccctatacctcctagactaccacgaacggtcgttacttaacgttaaggtaaacggttcggggtaccctagtacggtaacggttacgacggtcccgggtacacgtacgggtacgtcggtacggggaactacggtacttacccactacctacaactactacaaacncgcctacgacgacgtcctagtagttcgtagttacgaccttaacttacgtaaccgtacgtaaccttaaaccgttaacgtttaacttaccgtttaaacgttcccggttaccgtacccgtaccggtaaccggaaacgggtactaacggtaccgtaggaacgtaaacgttaaacgacgttgtacggctacgaacctacgtacgtcgtcttactaccttcttcccg

SEQ ID NO: 335420 - DNA, 590 bp, Homo sapiens
  misc_feature: GZ8MTXP02F7Y3E.22.57.F02.1.454.CMB.2.raw
  modified_base (240)..(241): a, c, t, g, unknown or other
  misc_feature (240)..(241): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (382)..(382): a, c, t, g, unknown or other
  misc_feature (382)..(382): n is a, c, g, or t
tcagacatacgcgtcacgaccggtgctcgatttagctcgatatagttgggtttggggagtcagacccagtcaggacacagcatggacatgagggtcccgctcagctcctggggctcctgctgctctggctcccaggtgccaagtgtgacatccagatgacccagtctccttccacctggctgcatctgtaggagacaggatcaccatcattgcggcagtcagaatataatgtgtgctgannagcagaaccaggaacncccctatacnctgactcacgaaggcgtactacgtttaagaaaggttcgggacccataccgaaagggttcaaggccggacaagtcggaatcgtagggaacagaattcatccacaaccatcaaagcncccagaccaagtcctagatagtagttaggtactaacttaactaacgtacgtaccgtaaaccgtaagttaacgttaacgttaacttaccggttacctaccgttaccggtaccgaacggaacgacgaaccgtacggaagtaagtaaaccgtaaacgtacgttaaggtcgtacgaacgacgtaactactacgttacttctaactttccccg

SEQ ID NO: 335421 - DNA, 605 bp, Homo sapiens
  misc_feature: GZ8MTXP02GZIKE.22.57.F02.1.454.CMB.2.raw
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (409)..(409): a, c, t, g, unknown or other
  misc_feature (409)..(409): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgagganacagagtcacatcacttgcggccagtcagaatattaatagttggtgctggtatnagcagaacaggaaacgcccctatactcagactaccacaaggtctactaacgttaaggaaaggttcggggtaccctagtactaaggttcgaagccccggactacgtggggtactaccggtaggggaacctagtaacttcacctctaccacataccaaacngcctcgctacgccctagactgtagtttacggaccttaaacgttactacgtacgtaacccgtaaacgtatttaacggtactttacgttaccggtactacccgttcggaccgtaacgggacaacgtacgtaggataaaccgttaaacggaacgttacgtcgactacgaaccactagttcctgtacttcacgtttcccc

SEQ ID NO: 335422 - DNA, 667 bp, Homo sapiens
  misc_feature: GZ8MTXP02INJWK.22.57.F02.1.454.CMB.2.raw
  modified_base (210)..(210): a, c, t, g, unknown or other
  misc_feature (210)..(210): n is a, c, g, or t
  modified_base (409)..(409): a, c, t, g, unknown or other
  misc_feature (409)..(409): n is a, c, g, or t
  modified_base (627)..(627): a, c, t, g, unknown or other
  misc_feature (627)..(627): n is a, c, g, or t
tcagacatacgcgtcacgaccggtgctcgatttagctcgatatagttggggtttgggggagtcagacccagtcaggacacagcatggacatgagggtccccgctcagctccgtggggctcctgctgctctggctcccaggtgccaagtgtgacatccagatcgacccagtcctcccttccacccgtggcctgctagttcgtaggtagganacagagtccaccatctacgttggccggacctagtacaagtaattattaagtggttggtcggcttaggtactcagacgaacgaaaccgagggaaacctcccctaatcccttcgtagactaccgaagtaacggtcttaactaacggtttaaggaacgggttccggtaaccagttaccgtaacggttcgacggtccgtaacncgttaggacttcggaaggtaactaggttaacttcgaaccttccctaccgaacctaatacccgaaatacgccgtgactacgtacctagtacgttagtacgtttacgaacttaacttacctacgtaacaccgttaacttagtttattaccgttacgtccgtactcggtaacggcgtaaagcgtacgtaaggtacgtaataacgtaacgtagtcgtacgtnacgaacttacgactttccgtatccttacaccgtttccccg

SEQ ID NO: 335423 - DNA, 550 bp, Homo sapiens
  misc_feature: GZ8MTXP02IGGWT.22.57.F02.1.454.CMB.2.raw
  modified_base (228)..(228): a, c, t, g, unknown or other
  misc_feature (228)..(228): n is a, c, g, or t
  modified_base (244)..(245): a, c, t, g, unknown or other
  misc_feature (244)..(245): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (534)..(534): a, c, t, g, unknown or other
  misc_feature (534)..(534): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagacgtcaccatcacttgtcggcagtcanatatatgtgtgctgtnnancagaaccaggaaacnccctatactcctgactccacgaaggcgtacttaacgttaaggaaaggtcggggtacccagtacgaaggtcagccgcagtgatcgtagggacagtaacttcactctacacataccaacagcctgcacgctagatgtattcgactaacttactactgacctaaccgtattacgtactttacgttcgtactacgttccggacgtaacgggacaccggtaactacgggaataacgttaaaacgacgttggtacgtcctgaacctacgtatccgttntaccttactacttccg

SEQ ID NO: 335424 - DNA, 616 bp, Homo sapiens
  misc_feature: GZ8MTXP02FLWW4.22.57.F02.1.454.CMB.2.raw
  modified_base (288)..(288): a, c, t, g, unknown or other
  misc_feature (288)..(288): n is a, c, g, or t
  modified_base (415)..(415): a, c, t, g, unknown or other
  misc_feature (415)..(415): n is a, c, g, or t
  modified_base (608)..(608): a, c, t, g, unknown or other
  misc_feature (608)..(608): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatcgacccagtcctccttccaccctggcctgcatcgtgtaggagacagagtcaccatcctacgttggcgggccagtacaagaatattaagtagttggttgcttggtatcgaagacaacgaaacgaggaacncccctatactcctagctaccacgaggtacttactaacgttaggaaacggttcggtacctagtacgaagttcgagcccgacacgtaggatcggaggaacagtatcacgtcctcgaaccataccaaccngcctgacacgcctagattagtagtttacgacctaactttaaccgtactaccgtaacccctaacgttaacgttaacgtttactttaccgttacgtaccctaccgttaccgggaccgtaagggtacgaccgtagtagggtaaactaaacgttaaacgacgttgtaccgattcaacgtacacgttactgtactacncgttaccc

SEQ ID NO: 335425 - DNA, 646 bp, Homo sapiens
  misc_feature: GZ8MTXP02JVZBF.22.57.F02.1.454.CMB.2.raw
  modified_base (304)..(304): a, c, t, g, unknown or other
  misc_feature (304)..(304): n is a, c, g, or t
  modified_base (492)..(492): a, c, t, g, unknown or other
  misc_feature (492)..(492): n is a, c, g, or t
tcagacatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgaccatccagatcgacccagtcctccttccaccctggctgcatctgtaggagacagacgtaccacctatctacgttcggtcgggaccagtacaagtaattaagttaagtacggttggttggccttaggtatcgaagcaacgaaaccgagggaaaccncccctaataccgtctagactaccaagacgtcgtacttaagttaaggaacggtcgggtaccatacgtaacggtcaaggtccgacgtaagtggaactcggtagggaacaggtactcaaccgtacactacctaataccgaaacgcgaccctagacgtacgcctagagtcgtaagttcgactaacctttaanccgtaacgaccgtaaaccgtattacggttacttacgtacgttaccgaccgttacggaccgtagggtaaccacgtacgtaacggtactaaacgttaaaacgacgttaggacgtacgtacgaaccgtactacgtactcggtacttacgacctttcc

SEQ ID NO: 335426 - DNA, 428 bp, Homo sapiens
  misc_feature: GZ8MTXP01COSWF.25.23.C01.1.454.CMB.2.raw
  modified_base (425)..(428): a, c, t, g, unknown or other
  misc_feature (425)..(428): n is a, c, g, or t
tcagactgtacagtcacgaccggtgctcgatttagtacacgtgattagggattgggcgtatatatacgaatggattaaccacctacaacccctccctcaagagtcgagtcaccatatcagcggacacgtccagggatcaggtgttcctgcatctgacttctgcgactgccgcggacacggccctatactactgtgccagagattcggactgcgacgatttttcggagaattattatctttgtgcttttgacatgtggggccaagggacgacggtcaccgtctcttcagcctccaccaaggcccatcggtcttccccctggcacccctcctccaagagcacctctgggggcacagcccggccctgggctgcctgggtcaaggctacttccactgtacagtctgagcgggctggcaaggcgcatagnnnn

SEQ ID NO: 335427 - DNA, 510 bp, Homo sapiens
  misc_feature: GZ8MTXP01CAESC.25.23.C01.1.454.CMB.2.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgtctgggagcagctccgacgtcggaaatagttgtctactggtaccagcagctcccagaaaccggcccccaagctcctcatctataggaatgatcagcggccctnagggatacctgaccgattctctggctcgagtcnggctccncgcctcctgccatcngtcgggctccggtcgagatgaggctagaatattactgtgctagttgggatgggcagtcngagtggtccgaggttgtcggnggaggccaagctgaccgtcttaggcngcccgaggctcgcccctgcncttcgtcgttccccncc

SEQ ID NO: 335428 - DNA, 533 bp, Homo sapiens
  misc_feature: GZ8MTXP01CRYJ7.25.23.C01.1.454.CMB.2.raw
  modified_base (189)..(189): a, c, t, g, unknown or other
  misc_feature (189)..(189): n is a, c, g, or t
  modified_base (406)..(406): a, c, t, g, unknown or other
  misc_feature (406)..(406): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccacctcagtgtctgggaccccgggnagagggtctccatctcttgtctgggagcagctccgacgtcggaaatagttgtctactggtaccagcagctcccagaaacggcccccaagctcctcatctataggaatgatcagcggccctcagggataccctgaccgattctctggctccgaatctggctctcgcctccctgccatcagtgggctccggtcgaggatgagctgaatattactgtggngtagttgtagtggtcgtacgtcgtgtagtcggtcggtcggtcggtcggtcggacggacgacgcgtcgacgtccgttcgtcgcgaccgcgcgtccgtcccgtccgtcgtcttcctccgttcccgtccc

SEQ ID NO: 335429 - DNA, 560 bp, Homo sapiens
  misc_feature: GZ8MTXP01CUCOY.25.23.C01.1.454.CMB.2.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (451)..(451): a, c, t, g, unknown or other
  misc_feature (451)..(451): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggaccccggnagaggtctccatctcttgtctgggancagctccgacgtcggaaatagttgtctactggtaccagcagctccagaaacgccccaagctcctnatcataggaatgatcagcggccctnagggatacctgaccgtattctctggctcgaagtctggcctccgtccggccctcccgtaggcccatcgagtcgggctcccgggtccgaggactggaggctggaaatattactggtgctaaggtttgggattgggcccgtaggttccngggtacgtcggtccgacgggttggttcggcgggaggggaccaaggctggaccgttcgaggtccaggccccgaggcctcgcccccgtggtccacttctcgttccccgccc

SEQ ID NO: 335430 - DNA, 525 bp, Homo sapiens
  misc_feature: GZ8MTXP01DJC9N.25.23.C01.1.454.CMB.2.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
  modified_base (491)..(491): a, c, t, g, unknown or other
  misc_feature (491)..(491): n is a, c, g, or t
  modified_base (508)..(508): a, c, t, g, unknown or other
  misc_feature (508)..(508): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtcgacatctcttgttctggaagtcgctccaacgtcggcagtaatagtgtaagctggtaccagcaactcccaggaacggcccccanactcctcatgtatggaatgatcagcgcccctnaggggtccctgaccgnttctcctgcctccacgtctcggcncctcacgccctccctggcccatcccgtggctccaatctgagatgagcgattattatgtgcgagngtggatgacgaggaagtaaacggttntgtctcggaattgggacaaggtcacgtcctggttcngcccaaggcccaacccnctcgttctcttcgtccg

SEQ ID NO: 335431 - DNA, 517 bp, Homo sapiens
  misc_feature: GZ8MTXP01CWYM4.25.23.C01.1.454.CMB.2.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggaccccggnagagggtctccatctcttgtctgggancagctccgagtcggaaatagttgctatggtaccagcagctccagaaacgccccaagctctcatctatagatgatcagcgccctnagggatacctgaccgattctctggctcgaagtctggctcctcggccctccctggccatcagtcgggctccgggtccgaggatgaggctagaaattattactgtgctagtttgggatgggccagtcnggagtggtccgaggtgtcggcggagggaccaaggctcgaccgtcaggtcagccccagggcctgccccctggcacttctcgttccccaaccc

SEQ ID NO: 335432 - DNA, 545 bp, Homo sapiens
  misc_feature: GZ8MTXP01ALQAN.25.23.C01.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (398)..(398): a, c, t, g, unknown or other
  misc_feature (398)..(398): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctcgacgtcggaaatagttgctactggtaccagcagctccagaaacggccccaagctcctcatctataggaatgatcagcggccctgagggactacctgaccgtattccctctggctcgaagtctgggctcctcggcctccctggccatcagtggctcggtcgaggntgaggctgaatattactgtgcgtagtttgggatgcctagtctggagtggtccgacggtggttcgggcggagggttacccaaggcgtacggacccgttccgttagggttccaacgcccgaagggcctcggccccctggttctaacccg

SEQ ID NO: 335433 - DNA, 537 bp, Homo sapiens
  misc_feature: GZ8MTXP01EPVPL.25.23.C01.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (444)..(444): a, c, t, g, unknown or other
  misc_feature (444)..(444): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgacgtcggaaatagtttgtctactggtaccagcagctccagaacgccccaagctctnatctataggaatgatcagcgccctnagggatacctgaccgattcnctggctcgagtctggcctccgtcggccctcccgtaggcccatcaggttgggcctccgggtccgaggatggaggctagaaatattactgtgctaggtttgggattgggcctagtcnggagtgggtcccgagggtgtcgggcggagggccaagctgaccgtcttaggcagcccgttaggcctcgcccctggtccncttctcgttcccncc

SEQ ID NO: 335434 - DNA, 532 bp, Homo sapiens
  misc_feature: GZ8MTXP01CCF0S.25.23.C01.1.454.CMB.2.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (490)..(490): a, c, t, g, unknown or other
  misc_feature (490)..(490): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgtctgggancagctccgacgtcggaaatagtttgtctatggtaccagcagctcccagaaacggccccaagctcctcatctataggaatgatcagcggccctnagggatacctgaccgattctctggctcgaagtctggcctcctcggccctcctggccatcagtcgggctccggtccgagatgaggctagaattattactgtagctaggtttgggattgggcctagtctggagtggtccgaggttgtcggcggagggaccaaggctgaccgtccgaggtcngcccgaggcctcgcccctggtccacgttctcgttcccaaccc

SEQ ID NO: 335435 - DNA, 518 bp, Homo sapiens
  misc_feature: GZ8MTXP01AYTV7.25.23.C01.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgacgtcggaaatagttgctactggtaccagcagctccagaaaccgccccaagctcctnatcataggaatgatcagccgcctcagggatacctgaccgattcnctggctccgaagtctggctcccgtcggccctcccgtggcccatccaggtgggctaccgggtcgaggntgaggctgaatattacngtgcgtagtttggatggcaggtctgagtggtcgacggtgtcggcggaggccaagctgaccgtcgaggtcagcccgagctcgcccctgcacttctcgttcccgccc

SEQ ID NO: 335436 - DNA, 248 bp, Homo sapiens
  misc_feature: GZ8MTXP01EZ17R.25.23.C01.1.454.CMB.2.raw
  modified_base (248)..(248): a, c, t, g, unknown or other
  misc_feature (248)..(248): n is a, c, g, or t
tcagactgtacagtcacgaccggtgctcgatttagtacacgtgattagggtgggcctactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccactgtacagtctgagcgggctggcaaggcgcatagn

SEQ ID NO: 335437 - DNA, 419 bp, Homo sapiens
  misc_feature: GZ8MTXP01BLYC9.25.23.C01.1.454.CMB.2.raw
  modified_base (329)..(329): a, c, t, g, unknown or other
  misc_feature (329)..(329): n is a, c, g, or t
  modified_base (415)..(419): a, c, t, g, unknown or other
  misc_feature (415)..(419): n is a, c, g, or t
tcagactgtacagtcacgaccggtgctcgatttagtacacgtgattagggattgggcgtatatatacgaatggattaaccacctacaacccctccctcaagagtcgagtcaccatatcagcggacacgtccagggatcaggtgttcctgcatctgacttctgcgactgccgcggacacggccctatactactgtgccagagattcggactgcgacgatttttcggagaattattatcttgtgcttttgacatgtggggccaagggacgacggtcaccgtctcttcagcctccaccaggcccatcggtctcccctgcaccctctccaagngcacctctgggggcacagccggcctgggctgcctggtcaaggctacttccactgtacagtctgagcgggctggcaaggcgcatagnnnnn

SEQ ID NO: 335438 - DNA, 733 bp, Homo sapiens
  misc_feature: GZ8MTXP01ETHUL.25.23.C01.1.454.CMB.2.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcggggacccccggnaggagggtctccatctcttgttctgggancagctccgagtacggaaattagtttgtctactggtaccagcagctcccaagaaccgccccaagcctctcatcatagatgatcagcgcctagaggtactaccgtgaccgtattctcgtggctacgaagtctcggccttcccgtcccggcccttcccgtgggccctagtcgacgggttcggggccttacccggggtccgaagggtacgtgggacgggtcttaaggtaaactttacgtttaccgttggtacgcgttaagggtttggggactcggggtacccgtaaggttccgtagggtacggttcgggttacccggtacgggtttcgggttcggggaccggggtaacgggtaacccgaagggtccggttaacggttacccgggtacccgtttaaaggggacccaaccgggttacccccggaaggggttccccgttccccgggtccccccccgttaaggggttaccccgtaaccctttcccgggtttaacccgttttccccccccgtaacccccg

SEQ ID NO: 335439 - DNA, 587 bp, Homo sapiens
  misc_feature: GZ8MTXP01D93ZW.25.23.C01.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaataagtttgtctactgtaccagcagctcccacgaaaccggaccccaagctcctcatactatagaatgatcagtttttcggccctcgagggactacctgaccgattcctctggctcgaagtcgtgtcctccgtccggtccctcccgtcggccacgtcgaggtcgggcgtccgggtccggaggagtaggaggctagaattattactgtgtcgtaggtttggatcgccgtagtcgtggtagtcggtccggtcggtcggttcgggcgggacgggacgaacgttcgtcgtaccgttccgttcggttcgaacgacccgaacgccgtccgccccgtccggttctaaccg

SEQ ID NO: 335440 - DNA, 670 bp, Homo sapiens
  misc_feature: GZ8MTXP01A4Q19.25.23.C01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (320)..(320): a, c, t, g, unknown or other
  misc_feature (320)..(320): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtacggaaattagtttgtctactggtaccagcagctccagaaacggccccaagctctcatctatagatgatcagcgcctcgagggactaccngaccgattctcgtggctcgaagtctcggctcctcggccctcccgtggccatcgaggtcgggctcccgggtcgaggtatggacggtctaggtaaattagttaacgtgtgtacgtaaggtttgggattcggggcctaggttcctaggaggttcggtccggtagggttcggttcgggcggggtaacgggacccgaaaggtccgtacgggttaaccccggttaccgttaacggggtacctaaccgggttacccccgaaagggggttccccgttccccgggcccccccccggtttggggtccccctaacccggtttccccgtttccccgggtttccccccccggttaaccccccg

SEQ ID NO: 335441 - DNA, 602 bp, Homo sapiens
  misc_feature: GZ8MTXP01A2PIC.25.23.C01.1.454.CMB.2.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
  modified_base (450)..(450): a, c, t, g, unknown or other
  misc_feature (450)..(450): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtcgtcgggaccccccgggcaggagggtctccatctcttgttctgggancagctccgacgtcggaaattagtttgtctactggtaccagcagctcccagaaaccgccccaagctccnatctatagatgatcagccggcccctgagggtactacccgtgaccgtatttcctcgtggcctacgaagttcgtggccctcccgtcgggccctcccgtgggacccatcgacggttggggcctaccgggtccgaggactggaggctagaaattatttacgngtcgctagggtttgggatcgggacctggttctggacggttggcccgagggttgttccgggcgggacggaccaggcttcggaacccgtcgttaggcaacggcccgttacgggctccgcccccgtaaggccctcgttccttccgttcccctccc

SEQ ID NO: 335442 - DNA, 543 bp, Homo sapiens
  misc_feature: GZ8MTXP01EA1DS.25.23.C01.1.454.CMB.2.raw
  modified_base (180)..(180): a, c, t, g, unknown or other
  misc_feature (180)..(180): n is a, c, g, or t
  modified_base (208)..(208): a, c, t, g, unknown or other
  misc_feature (208)..(208): n is a, c, g, or t
  modified_base (363)..(363): a, c, t, g, unknown or other
  misc_feature (363)..(363): n is a, c, g, or t
  modified_base (477)..(477): a, c, t, g, unknown or other
  misc_feature (477)..(477): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactaagtgtctgggacccccggnagagggtctccatctcttgttctgggancagctccgacgtcggaaatagtttgtctactggtaccagcagctcccagaacgccccaagctctcatctataggaatgatcagcggccctcgaggatacctgaccgattctctggctcgaagtctggctcccctcggcctcccgtggcccaatcnggtgggcctccgggtccgaggatgagctgaatatactgtgctagtttgggatgcctagtctggagggtcggtccggaggttgttcgggcggagggaccaaggctgacccgtcgnggtcacgcccaaggctcgccccttcggttccactcgtcttccccacctccttctaacttgtaaccg

SEQ ID NO: 335443 - DNA, 626 bp, Homo sapiens
  misc_feature: GZ8MTXP01AZ3Z5.25.23.C01.1.454.CMB.2.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (337)..(337): a, c, t, g, unknown or other
  misc_feature (337)..(337): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcggggacccccggnagagggtctccatctcttgttctgggancagctccgacgtcggaaataagtttgtctactggtaccagcagctcccagaaaccgccccaagctcctcatctataggatgatcagcggccctgagggactacctgaccgtattcncgtggctaccgagtctcggcctcccgtccggccctcccgtgggcccagtcgaggtcggggctcccgggtcgaggactggacggtctaggaaattatttactgtgcgtaggtttcgggattcgggacctaggttcgtggacggttcggtcccggtagggttggttccggggacggggtaggggacccaaggtccgtggttaaccccggtcgttagggtccgacggccccgaaggggccctccggcccccgttcgggtcctacggttcccttaaccgttcccctaaccccc

SEQ ID NO: 335444 - DNA, 615 bp, Homo sapiens
  misc_feature: GZ8MTXP01CDG6N.25.23.C01.1.454.CMB.2.raw
  modified_base (296)..(296): a, c, t, g, unknown or other
  misc_feature (296)..(296): n is a, c, g, or t
  modified_base (454)..(454): a, c, t, g, unknown or other
  misc_feature (454)..(454): n is a, c, g, or t
tcagactgtacagtcacgaccggtgctcgatttagtacacgtgattagggattggggagctgtggtagagaagacaggattcaggacaatctccagcatggccggcctccctctcctcctccaccctcctcactcactgtgcagggtcctgggcccagtctgtgctgactcagccaccctcagtgtcgtcgggaccccccggcagagggtctccatctcttgttctgggagcagctccgacgtacggaaatagtttgtctactggtacagcagctccagaaccgccccaagctccncatctataggaatgatcgacgccggccctgagggactaccgtgaccgtattccctcgtggctcgaacgtctcggcctcccgtccgggccctaccccgtggacctatccgaggtcgggcctccgggtccggaggagtggaggtctagaaattattacgngtgacggtaggtttgggattcgctagtctggtaggtcggtccggtacgggttggtcggggcgggaacgggacccgaaggttccgtacggtacccggttccgttacggggttccaacgggccccaagggtcccctccggttcccccgtcggttcctaacccg

SEQ ID NO: 335445 - DNA, 608 bp, Homo sapiens
  misc_feature: GZ8MTXP01BZNJC.25.23.C01.1.454.CMB.2.raw
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctcgtnagtgcttatcnggancgtggactccgcaggtccggcgggagggactggagtggagttgggcgtaatagtatacgaatggaacttaaccacctaacaacccctcctanaagngtcgagtcccacatatcagacggacaacggtcccgaaggggtacttcgagggttcgttccctgacctagtctagtaccttctcgccgtacgtgcccgcggacgaccggaccctaataccgtaactggtacaccgagagtacgtacggacgtcgacgtaacgttagttttcgggaaattaatttatttacttcgtttgttgttcgtttcgttacgtaagtggtcgggtacggacgggacggtaacggttcgtaaccg

SEQ ID NO: 335446 - DNA, 744 bp, Homo sapiens
  misc_feature: GZ8MTXP01BNY7W.25.23.C01.1.454.CMB.2.raw
  modified_base (246)..(246): a, c, t, g, unknown or other
  misc_feature (246)..(246): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggacgaccctgtcccctcacctgcagtgtctcgtggtggctccgtnagtgtcttatactggagctggactcccgcaggccggcgggagggtactgggagtggagttgggacgtaatagtaagtaacggaatacggtaaactttaaaccccgacccttaacccaaaccccccttcctaagaaacgtacgttacgaacgtaccccaacctataactaccgacgaacccgggaacctaaccggttacccgaaaggggtacttccgaaggggtttcttcccgtagactaacttccgtcggtactttcgtacggcccgtacgtccggcccgaccggaccgaccggtacccttaattaccggtacgtcggtacgaccgtaaggtacgtacgttccggaaccgtggtaccggttaacgtttacgtttttcgggaaattaacttttagtttagtttccgttttaggtcgttttacgttttggaaaccgttggttcggggttaacgggggtaacccgaagggggttacccgtaaccgggttccgttaacccgg

SEQ ID NO: 335447 - DNA, 597 bp, Homo sapiens
  misc_feature: GZ8MTXP01CYJF6.25.23.C01.1.454.CMB.2.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggaccccccggnaggcggtctcatctcgttgtcgnggancagctcgacgtagaaattagttntactacgtcgacagcacgccaccgaacgaaccgccccaagcctccnatactagtaagaatgactacgacggccgccctagacggtactaccgacgacgtacttccncgtcgctacgatcgtcgcctccgtccgccctccgcgcctagcgnggtcggccgtccggtacgagacgtaggacgtctagtaattagtacgtgtgtacggttaggttggactcggctgtcgtggtacggtcggtccgggtacgggtcggtcggggaacggaacgggacgtagccgtacggccggttacgttacggaccaacggtacccgaacggtcccgtcccggcccgtcggttcctccg

SEQ ID NO: 335448 - DNA, 672 bp, Homo sapiens
  misc_feature: GZ8MTXP01DQOAA.25.23.C01.1.454.CMB.2.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (409)..(409): a, c, t, g, unknown or other
  misc_feature (409)..(409): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtccgtcgggaccccggnaggaggtcctccatctcttgttcgtgggancagctcgacgtacggaaattaagttgtactactggtaccagcagcctacccaagaaaccgccccaagctcctcatctaataggaatgactcgagccggccctgagggactacctgaccgtacttcctcgtacggctacgtaagtcctcgggtcctcccgtcccgggtccctccccgngggccagttcgagggttcgggtccgtcccgggtacgagggtaacttgggaggtccttaggaaattacgttacgtgttcgcggttaaggttttgggacttcgccgtagtccgtaggtacggttcgggtcccggtagggttggttaccggggaacgggtaacgggacccgaaaggttccgtaaccggtcccgttaccgttagggttaccaacccggaacccgtaacgggtccctccggccccccgttcgggttaacccttccccg

SEQ ID NO: 335449 - DNA, 719 bp, Homo sapiens
  misc_feature: GZ8MTXP01A90XP.25.23.C01.1.454.CMB.2.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcggggacccccggnaggaggtcctccatctcttgttctgggancagctccgacgtacggaaattagtttgtctactggtaccagcagctacccagaaaccgccccaagctccnatcanagatgatcagccgccctgagggactacctgaccgtattcctcgtggccttacgaacgttctcggtcccttcccgtcccgggtccccttcccgtgggccctaacgttcggaacgggtccgggggcccttccccggggtaccgagggtacgtggaacgggtctaggtaaacttatttacgtgggttacgacgttagggttttacgggaattcggggtacccgtaaggttccgttagggtacggttcgggtacccgggtacggggtttcggggttccggggaacgggggacgggtaaccctaaggtccgttacggttacccggttccgttaggggtacccacggaccccgaggggttcccttcccgggcccccccgttgggtaccctacccgtttcccgtcccggttttaacccccccgtccccg

SEQ ID NO: 335450 - DNA, 688 bp, Homo sapiens
  misc_feature: GZ8MTXP01AGMWX.25.23.C01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctcccagaaaccggccccaagctcctcatctataggaatgatcagcgcctnagggatacctgaccgtattctctggctcgaagtctggctccgtcggccctcccgtggcccatcgagtcgggctcccgggtcgaggactggaggctaggaacttagttacgtgtcgtcgtaagggtttggggacttcggggcccgtaggttccgtagggtaacggttcgggttacccggtacggggttcgggtttaccggggcggggtaaacggggaacccgtaaagggtccgtcgggttaaacccggttccggttacggggttacccgaacgggttacccccgaaaggggttccccttaacccgggtccccccccgtttaacggggttacccctacccgtttcccggttcccggttttccccccgggtaaccccccg

SEQ ID NO: 335451 - DNA, 680 bp, Homo sapiens
  misc_feature: GZ8MTXP01EXMZI.25.23.C01.1.454.CMB.2.raw
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgttctgggagcagctccgacgtacggaaattaagtttgtctactggtaccagcagctcccaagaaccggccccaagctcctcatctatagaatgatcagccgcctgagggactacccgtgaccgtattctcgtggctaccgaagtcgtcggcctcccgtccggccctcccgtcggcccagtcgaggtcgggccgtcccgggtccgaggacgtggacgctagtaaattagttactggttagcgttagggtttagggacttacggggccgtaggttccgtagggtacggttcgggtaccgggtacgggttcgggttcggggacggggtaacgggaaccgaaggtccgtacggttaccccgggttccgttacgggtacccgaaccgggaccccgttaaggggttccccttcccgggcccccccgttcgggtcccctaccgttcccgtttcccggtttcccccccgttaacccccg

SEQ ID NO: 335452 - DNA, 605 bp, Homo sapiens
  misc_feature: GZ8MTXP01ASFHE.25.23.C01.1.454.CMB.2.raw
  modified_base (199)..(199): a, c, t, g, unknown or other
  misc_feature (199)..(199): n is a, c, g, or t
  modified_base (443)..(443): a, c, t, g, unknown or other
  misc_feature (443)..(443): n is a, c, g, or t
  modified_base (517)..(517): a, c, t, g, unknown or other
  misc_feature (517)..(517): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaataagtttgctactggtaccagcagctacccgagaaaccggccccaagctcctcatctatacggaatgatcgagccggccctcgagggactacctgaccgtattccctcgtgctacgagtctggcctccgtcggccctcctggccatcgaggtcggccgtccggtccgaggtactggacggtctagtaattagttaacnggttgcggtaaggttttggggatcggcctaggtcgtaggtacggtcgggtcccggtagggttcggttccggggngggacgggttaccaagggctacgggtacccgttcgttaggttccaacggccccgaagggtcctccggccccttcgggttcctaacccg

SEQ ID NO: 335453 - DNA, 619 bp, Homo sapiens
  misc_feature: GZ8MTXP01DBBP1.25.23.C01.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
  modified_base (341)..(341): a, c, t, g, unknown or other
  misc_feature (341)..(341): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccacctcagtgtcgtcgggacccccggnagaggtctccatctcttgttcnggancagctcgagtagaaatagttnctacngtaccngcagcctaccgaacgaaccgcccaagctccnatctagtagatgatcacgccgcctagaggactaccgcgaccgtattcccgngaacggtctacgtaacgtcgtcggcctcccgtccgggcccttcccgcggaccctaatcgacggtcggccgttccgggacgaagtgtacggacggtactaagtaaattacgttacgtgtacgtacggttagggtttaggggacttacggccgtagtcgtaggtacggtcgggtccggtaacgggtcggttcggggaacggtaacggaccgaagttcgtacgtaaccgttcgttacggaccaacggaccgaagtccccacgttccccttcgaacgtcccg

SEQ ID NO: 335454 - DNA, 693 bp, Homo sapiens
  misc_feature: GZ8MTXP01CMMUZ.25.23.C01.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgagtcggaaattaagtttgtctactggtaccagcagctacccagaaccggccccaagctcctcatctataggaatgatcagcgccctgagggactaccgtgaccgtattcctcgtggctacgagtctcggcctcccgtccgggcccttcccgtggaccctagtccgtacggttcggggcccgttcccggggtaccggagggtacgtgggaacgggtccttaaggtaaacttacgtttaacgtgttacgtcgggttaagggtttttggggaattcggccgttaaggttccgtaggtaacggttccggggtacccggtacggggttcgggttccgggggaaccggggttaaacggggacccgtaaacggccgtaacgggtcccgttaccggttagggttacccgaacggccccgtaacggcccgttcccgggccccccgttaacgggttcccttccccgg

SEQ ID NO: 335455 - DNA, 690 bp, Homo sapiens
  misc_feature: GZ8MTXP01AJSQJ.25.23.C01.1.454.CMB.2.raw
  modified_base (191)..(191): a, c, t, g, unknown or other
  misc_feature (191)..(191): n is a, c, g, or t
  modified_base (293)..(293): a, c, t, g, unknown or other
  misc_feature (293)..(293): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnagaggtctccatctcttgtctgggagcagctccgacgtacggaaatagttgtctactggtaccagcagctcccagaacgccccaagctctcatctataggangatcagcgcctcgagggactacctgaccgtattcctcgtcggctaccggaacgtcgtcgggccctcccgtacccgggcccttcccgtcgggccctaacgtcgagggttcgggccgtccgggtaccgaggtacgtggacggtctaggtaacttatttacgtggtgacgttaggtttaggggatcggggtccgtaaggttccgtagggtacggttcgggtcccggtaacggggttcggttaccggggtaccgggtaacgggtaacccgtaaaccggtcgggtaacccgttccggttcggggttccgaaccggtacccggaacgggttcccttccggtccccccgttcgggtaacccgtccttcccgttcccggtttcccccgttaaccccgtttccccg

SEQ ID NO: 335456 - DNA, 719 bp, Homo sapiens
  misc_feature: GZ8MTXP01CRXNX.25.23.C01.1.454.CMB.2.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagcggtctcattctcttgtcgtggacncagtccgtaccgacgtacgtaaattagttcgtactacgtcgtacagcacgcctacccgaacggaaacccgaccccaacgtcctcctactacttactaagtagaatcgactacgacggtccggtccctacgaacggtactaccgtacgacgtacttcccgtcgtcggtaccgtacgtaacgttcgtcggtcccttcccgtccggtccccttcccggtacggcctacgtcgtacggtcgggtccggtccgggtacggagggtacgtacggtacggtacgtaacgtaaagttacgttacgtggtacggtacgggttaggggtttaggacgttacggaccgtaggttcgtacgggtacggttccggggtaccggtacgggttcgggtaccggggaacgggtaacgggaccgtaacggttccggtacgtaccgttacgttcggaccgaaccggacccggtaacggtcccgtcccgttccccgttaacggttcctccg

SEQ ID NO: 335457 - DNA, 573 bp, Homo sapiens
  misc_feature: GZ8MTXP01AK9YF.25.23.C01.1.454.CMB.2.raw
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (474)..(474): a, c, t, g, unknown or other
  misc_feature (474)..(474): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggacgaccctgtccctcacctgcagtgtctctggtgctccgtcagtgtcttattactggagctggactcccggccaggtcccggccggggagggactgggagtggagttgggctatatatacgaatggaacttaacccacctaaccaaccccctcctacaagcgtcgactcccaccatatcgagaccggacncgtccgagggatcgaggttctccngcatctgtacttcngcgactcgccgcgacnccggtacctatacgtactgtcaccgagngtcgttcggactgtacgtacgttagttttcggaattaatttnttattcgtttgtnttcgtttgactgtggtcgggacgagggcgtaacgttcgtaaccg

SEQ ID NO: 335458 - DNA, 572 bp, Homo sapiens
  misc_feature: GZ8MTXP01CPK6K.25.23.C01.1.454.CMB.2.raw
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (473)..(473): a, c, t, g, unknown or other
  misc_feature (473)..(473): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctcgtggtggctccgtnagtgcttatactgganctggactccgcagccggcgggagggactggagtggagttgggcgtatatatacgatggaactaacccactaccaaacccctcctanaaagcgtcgagtcccaacctatacgtcaaggccgggaacncggtccaaggggactcgagggtcgttcccngctatctgacttcngcgactgccgcggacacggcctaagtactacgtgtcgcagagngttcggaactgcgtacgtattttcgggaattaattagttattcgtttgtgttacgttttgaactgtggtcggggactagggcgtaacggttcgtaaccg

SEQ ID NO: 335459 - DNA, 722 bp, Homo sapiens
  misc_feature: GZ8MTXP01DECH3.25.23.C01.1.454.CMB.2.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcggggacccccggnaggagggtctccatctcttgttctgggancagctccgacgtacggaaattaagttgtactactggtaccagcagctaccgaagaaaccggccccaagcctcctacactactagtaggaatgaatcgaggacggccccttagaacggggtacttacccgtcggaccgtactttcccgtcgtcggtcctacggaagttccgtcgggtccctcccgtccggtccccttccccgtcgggccctaacgtccgagggttcgggccgtacccggggtccggaaggtagtaggaacgggtctaaggtaaacttacgttaaccgtgggttaccgtacggggttagggtttttacgggggaacttcgggtacccgtaaggttccgttagggtaacggttcgggtccccgggtagggttcggtttcgggggaacggggtacggacccgtaaggcgtaccggtacccgttccggttggttaccgcggtacccgaaggtcccgtaccggttccccgttcgggttcctaacccgg

SEQ ID NO: 335460 - DNA, 609 bp, Homo sapiens
  misc_feature: GZ8MTXP01A8K10.25.23.C01.1.454.CMB.2.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (398)..(398): a, c, t, g, unknown or other
  misc_feature (398)..(398): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtggctccgtnagtgtcttattacnggagctggatccgcaggtccggcgggagggactgggagtggagttgggcgttaatataagtacggaagtcggaacttaaaccccacctaaccaacccccttcctacaaaggacgtcgatcccaaccatactcaggacgacncgtaccagggtactcgaggttcgtctgcatctgacttctgacgactcgccgacggaccaccggtacctatacctacgtcgtcgaccgagacgtacgttcgggaactcggtaccggtacgttacgttttcggaagttaatttatttattcgtttagttgttcgttttgattgtgggtcggggacgtaaggggaccgtaacggttcgtaaccg

SEQ ID NO: 335461 - DNA, 521 bp, Homo sapiens
  misc_feature: GZ8MTXP01CY87X.25.23.C01.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
  modified_base (507)..(507): a, c, t, g, unknown or other
  misc_feature (507)..(507): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcctcgggacccccggnagagggtctccatctcttgttctgggancagctccgacgtcggaaataagtttgctactggtaccagcagctcccagaaaccgccccaagctcctnatctataggaatgatcagcggccctnagggatacctgacgatttccnctggctacgaagtcnggctccctcggccctcccagcctatcagtggctcggcgaggatgagtctgaatattactgtgacgtagtttgggatcggccaggtctgagtggtccgnggtgtcgggnggaggacagcgtgcttccgttggcaagcccctaaggcccnccgccccgtcgctc

SEQ ID NO: 335462 - DNA, 603 bp, Homo sapiens
  misc_feature: GZ8MTXP01A0HET.25.23.C01.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggnagagggtctccatctcttgttctgggancagctccgacgtacggaaattagtttgtctacgtggtacagcagctacccagaaccggccccaagctcctacatctataggatgatcagccgccctcgaggactaccgtgaccgtattccctcgtgctacgaagtctgcctccgtccgggcccttcccgtggacccagtcccgaggttcgggcctccgggtcgaggagtggacggtctagaattacgttactgtgcgttaggtttggattcgccgtgtcgtggacgttcggtccggtacggttcggttcgggcgggaagggacccgtaagcgtacggaacccgttccgttacggcctaacggccctaacgggtccctcccggttcccccgtcgggttcctcccg

SEQ ID NO: 335463 - DNA, 605 bp, Homo sapiens
  misc_feature: GZ8MTXP01D7TC0.25.23.C01.1.454.CMB.2.raw
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctcgtnagtgcttatactgganctggactccgccaggtccggccgggaggggactggagtggattgggcgtatatatacgaatggaacttaaccacctaccaacccctcctanaagngtcgatccaccatatcacgacggacncgtccaaggggtactcgagggttctccgtgctactctcgtacttctcggacgacgtcgccgacggaccaccggaccctagtacctacgtgtcgaccgagagtacgttacggaactcgtcggtacgttagtttttacggaagttaatttattactttcgtttagttgttcgtttgacgttaagtgggtcggggaccgtaaacggggaccgtaaccggttcgtaacccg

SEQ ID NO: 335464 - DNA, 542 bp, Homo sapiens
  misc_feature: GZ8MTXP01DIYBS.25.23.C01.1.454.CMB.2.raw
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctcgtnagtgtcttatactggagctggatccgcagccgcgggagggactggagtggattgggcgtatatatacgaatggaatttaaccacctaacaacccctcctanaagagtcgacgtccaccatatcagccggacncggtccagggactcgaggtcgttccngcatctgacttctgcgactgccgcggacacggacctatacgtctgtncctagagngttcgatgcgtacgtntttcggaataattattacttgtttgtcgttcttttgactgtgtcgggcgtagggacgtaacgttcgtaaccg

SEQ ID NO: 335465 - DNA, 609 bp, Homo sapiens
  misc_feature: GZ8MTXP01A5K9L.25.23.C01.1.454.CMB.2.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgtctgggancagctccgacgtcggaaatagtttgtctactggtaccagcagctccagaacggcccccaagctcctcatctataggaatgatcagcggccctcagggataccctgaccgtattctctggctccgaagtctggcctcctccgggccctccctggccatcacggtgggcctcccgggtccgaggactggagggctggaaattattactggtgcgtaggtttggggatcggggcctaggttcctggaggttcgggtccggtacgggttggttcggggcgggtaagggaccgaacggcgtcggacccggtccgttagggtaccgacggccccgaagggttcccgtccggtccccccgtcggtcccaccgttcctcccgtttcccccgtaacccccg

SEQ ID NO: 335466 - DNA, 745 bp, Homo sapiens
  misc_feature: GZ8MTXP01DGUI0.25.23.C01.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtcgtcgggaccccggnagaggtctccatctcttgttctggancagctccgacgtacgaaattagttgtctacgtcggtaccngcagctacccgaagaaacccggcccccaagtcctccctacatactaagtaaggaaatcggactcgacggccccggaccccgttacgaacggggtacttaccccgtacggaacccgtactttcccgtccgttcgggccgttaccggtaaacgttcccgttcgggtcccttcccggtcccgggtccccttccccgtcgggaccctagtccgtacggttcggggtcccgtaccggggtaccgaagggtacttagggacggtacgtagtaaattacgtttacgtaggttcgtaggttacgggttttggggacttcggaccgtagttcgttaggtacggttcgggttcccgggtagggtttcggtccgggggaacggtaacggggacctaaacggttcccgtacggtaaccccgttcggttacggttacccgaaccggacccgtaacggtcccgcccgttcccccgttaacggcctttaacccg

SEQ ID NO: 335467 - DNA, 510 bp, Homo sapiens
  misc_feature: GZ8MTXP01ESOL7.25.23.C01.1.454.CMB.2.raw
  modified_base (340)..(340): a, c, t, g, unknown or other
  misc_feature (340)..(340): n is a, c, g, or t
  modified_base (494)..(494): a, c, t, g, unknown or other
  misc_feature (494)..(494): n is a, c, g, or t
  modified_base (499)..(510): a, c, t, g, unknown or other
  misc_feature (499)..(510): n is a, c, g, or t
tcagactgtacagtcacgaccggtgctcgatttagtacacgtgattagggattgggcgtatatatacgaatggattaaccacctacaacccctccctcaagagtcgagtcaccatatcagcggacacgtccagggatcaggtgttcctgcatctgacttctgcgactgccgcggacacggccctatactactgtgccagagattcggactgcggacgtattttttcggaagtaatttatttattcttttgtgtctttttgactagtgggtcggggaccaaggggacgacggtcaccgtctctcagccctcaccgacggcccagtccggtccttcccccgnggcccaccccgtcctaccgaagaccgcctaccgtcggtcgggggaccacgcggccccggcccgtggggctcggcccgtagggacgaaggtcccttaccttcccacgttacgtacaggttccgaggacgggccgggcgtggaccgaaggggccanagtgnnnnnnnnnnnn

SEQ ID NO: 335468 - DNA, 628 bp, Homo sapiens
  misc_feature: GZ8MTXP01CR2HU.25.23.C01.1.454.CMB.2.raw
  modified_base (180)..(180): a, c, t, g, unknown or other
  misc_feature (180)..(180): n is a, c, g, or t
  modified_base (208)..(208): a, c, t, g, unknown or other
  misc_feature (208)..(208): n is a, c, g, or t
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactaagtgtctgggacccccggnagagggtctccatctcttgttctgggancagctccgacgtcggaaataagtttgtctactggtaccagcagctcccagaaccggccccaagctcncatctatagatgatcagccggcctgaggataccgngaccgtattctcgtggctcgaagtctggcctccccgtccggcctccgtaggcccaaattcgaaggtcgggtcctccgggtccgaggactggaggtctagtaactagttactgtgacttagggtttgggattggcctaggtcgtggacggggttcgggtaccggtacgggttgggttccgggcgggaacggaccgaacggtcgtacggaccccgttacgtagggtccacggcccgtaaaggccctccggtcccccgttggttcccttaccgttccgtcccggttccccctccgtccccttactaaccgttcggtaaccg

SEQ ID NO: 335469 - DNA, 684 bp, Homo sapiens
  misc_feature: GZ8MTXP01AD5YG.25.23.C01.1.454.CMB.2.raw
  modified_base (180)..(180): a, c, t, g, unknown or other
  misc_feature (180)..(180): n is a, c, g, or t
  modified_base (226)..(226): a, c, t, g, unknown or other
  misc_feature (226)..(226): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctnagtgtcgtcgggacccccggagaggtctcatctcttgtcgtgggancagctccgacgtacggaaattagtttgctacgtggtaccagcagcctaccgaacgaaccggccccaagtcctccgtcatacctataggaatgatcacggccgccctacgagggtactaccgtgaccgtattcccgtctggtcgtacggtaagtccgtcggtccctcccgtacccggtcccgttcccgtcgggtccctaacgttccgtacggggtcgggtacccggttcccgggtaccgggaggtacgtacgggacggtcgttaacgttaaacgttagttaaccgttgggttcggtacggggttaaggggttttcgggaacgttccggtaccgttaacgtcgttagggtacggttcgggtccggtacgggttcggttcgggcggaacgttacggattcgtacgtcgttcgttaggttcgaacgaccgtaacgtccgtccgacccgtcgttaacgttccc

SEQ ID NO: 335470 - DNA, 614 bp, Homo sapiens
  misc_feature: GZ8MTXP01A89VA.25.23.C01.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
  modified_base (465)..(465): a, c, t, g, unknown or other
  misc_feature (465)..(465): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtcgtcgggaccccccggnaggagggtctccatctcttgtcgngggancagctcgacgtcggtaaatagtttgactacgtggtacagcacgctacccgaagaacccggccccaagcctcctnatctagaggatgactcgagtcgccctagaggacttaccgngaccgtattcccngtggctacgacgtcgngtcctccgtccggtccctccgtggcctagtcgacggttcggccgttccgggtccgaggntacgggagtctggtaattagttacgtgtcgnggttaggtttggactcgcgtagtcgtaggcggttcggtaccggtacggttcgggtcgggaacgggtaacgacccgaaggccctaggtacccgttcgcgttacgaacccgtacggaaccgtccgtcccgcccgttcgttaaccgttcccg

SEQ ID NO: 335471 - DNA, 692 bp, Homo sapiens
  misc_feature: GZ8MTXP01DB5D5.25.23.C01.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggaccccggnagagggtctcatctcttgtctgggngcagctccgaacgtcggaaattagtttcgtctactggtaccagcagctacccgaagaaaccggccccaagcctcctcatctataggaatgatcgacgccggcctacgacgggtactaccgtagaccgtattctcgtgctacgaagtcgtgcctccgtccgccctcccgtcgccctactcgtacggtcggggtaccgtcccgggacgtacggagttacggagggaccttaggtaaatttacgtttaacgtggttcggtacgttagggtttaggggtaacgttcggggtaccgtaggttccgttagggtacgggttccgggtaccgggtacggggtttcgggttaccgggggtacggggtacgggaacccgaaaggtccgtcgggttacccgttcggttacggttacgcgcccggaaacgggttcccgtcccggtccccgtcggttaccctccgttccgttcccgttccccgtccccg

SEQ ID NO: 335472 - DNA, 805 bp, Homo sapiens
  misc_feature: GZ8MTXP01B83VN.25.23.C01.1.454.CMB.2.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcggggacccccggnaggacgggtctccatcttcttgttctgggancagctccgagtacgaaattagttntctatggtaccagcacgcctacccgaacggaaacccggcccccaagccctcctactactactaagtaagggaatggactaccgaacggcccggtaccccgtagaacggggtacctaacccgtacgtaacccggttatttccgtacgtcgggtacctacccgggtaacggttccgtcgggtccccttcccggttaccccgggtccccttccccggtacgggtacccctaacgggttacccgtaacgggggttccgggggtacccgttccccgggggttaccgggaagggtaccggttagggaacggtccgttaaggtaaactttacgtttaacgtgggtacgtacggttaagggttttagggacttcggggtacgttaggttccgtagggtacgggttccgggtacccggtacggggttgggtaccgggacggggacggaccgtaggtccgtcgggttacccggtcgttacggtcgaaccccggccgttaacgggccctccccgggtacccccgttcggttacccgtccgttccggttccccgttcccccggttcccc

SEQ ID NO: 335473 - DNA, 715 bp, Homo sapiens
  misc_feature: GZ8MTXP01D9K0W.25.23.C01.1.454.CMB.2.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (473)..(473): a, c, t, g, unknown or other
  misc_feature (473)..(473): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtcgtcggggacccccggnaggagggtcctccatcttcttgttcgtgggancagctccgacgtacggaaattagtttntctactggtaccagcagcctacccgaagaaaccggccccaagcctcctacatctaataggaatgatcagccgccctagaggatacccgtgaccgtattctcgtggtctaccgaagttcgtcggccctcccgtcccgggcccttcccgtggacccctagttcgagggtccggggccttcccgggtacgaggtacgtggaggtctaagtaaattacgtttanggtagcgttaagggtttgggacttcgggaccgtaggttccgtgggacggttcggggtacccgtaggggttcgggttccggggacggggtaacggacccgaaggtccgttacgggaaccccggttcgttaacggggaccctaaccgggaccccgttaaggggttccccttccccgggtccccccccgtttgggtaacccctacccggtttccctttccccggtttaacccccccctaaccccg

SEQ ID NO: 335474 - DNA, 721 bp, Homo sapiens
  misc_feature: GZ8MTXP01BGY9K.25.23.C01.1.454.CMB.2.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
tcagactgtacagtcacgaccggtgctcgatttagtacacgtgattagggattgggggagctgtggtagagaagacaggattcaggacaatctccagcatggccggcctccctctcctcctccaccctcctcactcactgtgcagggtcctgggcccagtctgtgctgactcacgcccaccctcagtcgtccgtcggggacccccggnaggaggtcctccattctntttgttcgtgggancagcctccgaacgtacggtaaattagtttcgtactacgtcggtaccagcacgcctacccaacgaaacccggcccccaagccctcctacatactaagtaggatgactcgacggccggaccctagacgggtactacctgaaccgtattcccgtcgtcggactacgagttccgtcgtccctcccggtcccggtccctcccgtacggaccctagtccgtacggggtcggccggttcccgggtacggaaggtgtacggacggtactagtaaacttagttacgtggtgtacggttaggggttttacggagtaccggaccgttaggtccgttaggtacggggtttaccggggttcccggggttaacgggttcgggttacccgggggaacgggaacggttaaccgaacggttcgtaccggtacccgttacggttcggaccgaacggacccgtaacggtcccgtacccggccccgtggttaaccttcccg

SEQ ID NO: 335475 - DNA, 687 bp, Homo sapiens
  misc_feature: GZ8MTXP01EYC38.25.23.C01.1.454.CMB.2.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (384)..(384): a, c, t, g, unknown or other
  misc_feature (384)..(384): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtcccctnacctgcagtntctctggtgctccgtnagtgcttatactgganctggactccgccaggcccggcgggagggactgggagtggagttgggctatatatacgaatggaacttaacccacctacccaacccctcctanaagngtcgagtcccaccatacgcacggacgacncgtcgaagggctcgagggttctcctgctatctgtacttcgtgtaccgacgtcgcccggaccggaccgacccgggtacccttaacgttaaccgttaacgttcgggtacgacccgaaggtaacgtacgtttaccgggaaccgttcggtaccggttacgtttaacggttttttaccgggaaagtttaacgttttactttaagtttccgttttaggttgtttaccgtttttggaaccgttaagttcggggttaacgggggtaacccgaacgggggttaccggttaaccgggttcccgttaaccccgg

SEQ ID NO: 335476 - DNA, 671 bp, Homo sapiens
  misc_feature: GZ8MTXP01DVG44.25.23.C01.1.454.CMB.2.raw
  modified_base (245)..(245): a, c, t, g, unknown or other
  misc_feature (245)..(245): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggacgaccctgtcccctcacctgcagtgtctcgtggtgctccgtnagtgtcttatactggagcgtggactcccgccaggtcccggcgggagggactgggagtggagttgggctaatatatacgaatggaacttaacccacctaccaacccctccanaagngtcgatccaccatatcagaccgacncgtccaagggactcgaggtcttctgcatctagtacttctcgacgtacgtcgccgccgggaaccaccggaccctaagtaccgtacgttcggtacgaccgaagtacgtacgtttaccggaacgttcgtaccggtaacgttaaggtttttaccgggaaagtttaaattttaagttttaaccttttcgttttagttcggtttacgttttttgggaaaccttaagggttaggggttaacgggggacccggtaaaagggggttaccggtaaccgggttcccgtttaacccgg

SEQ ID NO: 335477 - DNA, 552 bp, Homo sapiens
  misc_feature: GZ8MTXP01ABZC9.25.23.C01.1.454.CMB.2.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactgggtgaagccttcggagacccctgtccctcacctgcagtgtctctggtgcttccgtnagtgcttattactgganctggatccgcagtccgcgggagggactggagtggattgggctatatatacgaatggaattaaccacctacaacccctcctanaagagtcgagtccaccatatcagacggacaacgtccaaggggtatccgaggtgttacctgctatctgacttctgcgactgccgcggacacggcctatactactgtcgccagacgagttcgacgtgcgtacgtattttcggaagtaattagttattgttgttgttcgttgttacgtgtggtcgggacggacggacggtcggttcgtccg

SEQ ID NO: 335478 - DNA, 648 bp, Homo sapiens
  misc_feature: GZ8MTXP01A49K1.25.23.C01.1.454.CMB.2.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtccgtcgggaccccccggaggagggtcctccatctcttgttctggaatcgctccaacgtcggctagtaatagtgaagctggaccagcaactcccaggaaccgcccccacactcctcatgtatggaatgatcacgccgcccctgacgggtccctgaccgtattcncctcgcctcacgtctagcccnctcacgccctccgtagccacgtcccgtggctaccgaatcgtagaggatcggaacggtccgtaatttacttagttggtcggacggtacgggtcgggtagggtacgtacggaacggtaagggtaaacggtacggtttacgtacggtttacgttaacgggtaaggttaaccggggaaccgttaacgggttcccgacccggtttaccgtaacggttcccgaccggttaccccgaacccggtacccctaacccgtcgtccgttacctaaccgttcccgtcccg

SEQ ID NO: 335479 - DNA, 744 bp, Homo sapiens
  misc_feature: GZ8MTXP01AMOBX.25.23.C01.1.454.CMB.2.raw
  modified_base (267)..(267): a, c, t, g, unknown or other
  misc_feature (267)..(267): n is a, c, g, or t
  modified_base (331)..(331): a, c, t, g, unknown or other
  misc_feature (331)..(331): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtcccctcacctgcagtgtctcgtgggtcggctccgtacaggttcgactttattacgngggagcctggactcccgccgacggtcccggccgggggagggtcgtgggaggtggagtttggggnttaatagtagtacgaatggaacttaacccgacctaaccaacccccttccctaacaacggtacgtccgacgttacccaacccgtatacgtaccgaggtacccgggaacctaaccggtcccgaaggggtactcggtaacgggttcgttccctgaccgtacgttacgttcggtacctttcgtcggtaacccggtcgttccggggacccgtacccgggaaccgtacccgggtacccctttaacgtaaccttacgttcgggtcaacccgtacgtagtacgttccgggtaacgtcggtaccggtacgtttaacgttttcgggaaattaaagtttatttacttgttttcgtgttttaccgttttagacgttggtggggtcgggtaaccgggtaggggaccgttaacggttccgtaacccg

SEQ ID NO: 335480 - DNA, 792 bp, Homo sapiens
  misc_feature: GZ8MTXP01AIV8Q.25.23.C01.1.454.CMB.2.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcacgcccaccctcagtcgtcgtcggggacccccggnaggacgggtcctccatcttcttgttcgtgggancagccgtaccgacgtacggtaaattagtttcgtctacgtcggtaccagcacgcctacccaacggaaacccggccccaagcctcctcatactagtaacggaatggactccgacggccccggtccgtacgaacggggtaccttacccgtacggtaccgttactttcctcggtacggacctacggtaacgttcgtccggtacccttcccggtcccgggtcccctccgtcgggtaccctacgttcggtacggggttcggggtcccgttacccggggtaccggtaaggtacgtacgggtacgggtacttaaggtaaaactttcgttacgtggtacgcggtttagggttacgggtacgttcggggacgtacggtttcggtacgggtacgggttccgggtaccggtacgggggttaccggttccgggggaccgggtacgggtaacccagggttccgtaaccgggttacccgttaggttacgggtcccaacggggttccccgttacgggttcccctaacccgggtccccgttcgtaccgtccttcccgttaaccccgttcccctaaccccg

SEQ ID NO: 335481 - DNA, 648 bp, Homo sapiens
  misc_feature: GZ8MTXP01BPDME.25.23.C01.1.454.CMB.2.raw
  modified_base (263)..(263): a, c, t, g, unknown or other
  misc_feature (263)..(263): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtcccctcacctgcagtgtctcgtgggtcgcttccgtcagtgtctttattacgngggagctggactccgccacggccggcggggaggggctgggaggtggagttgggctatatatacgaatggaacttaaccacctaccaacccctcncaagacgtcgactcccaccatacncgaggaccgacgtaaccgtcaaggggtactcgtaggttcttacncgacgtatctacgtacttgtgaccgaccgtcggcccgacggaacctccgggtacccctataccgtacgttgcgaccgtagacgtacgtacggacctagtacccggtagttacgttttacgggaattaaattttcgtaattccgttttagtcgtttaacgtttgaacgttggtggggtaaccggggtactaacggggttaccggtaaccgttcgggtaaccccg

SEQ ID NO: 335482 - DNA, 532 bp, Homo sapiens
  misc_feature: GZ8MTXP02IWO3V.25.23.C01.1.454.CMB.2.raw
  modified_base (202)..(202): a, c, t, g, unknown or other
  misc_feature (202)..(202): n is a, c, g, or t
  modified_base (325)..(325): a, c, t, g, unknown or other
  misc_feature (325)..(325): n is a, c, g, or t
  modified_base (422)..(422): a, c, t, g, unknown or other
  misc_feature (422)..(422): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtctgggaccccccgggnagagggtctccatctcttgttctgggagcagctccgacgtcggaaatagtttgctatggtaccagcagctcccagaaaccggcccccaagctcctcatctataggaatgatcagccggccctnagggactacctgaccgattcctctggctcgagtctggctcctcggccctccctgccatcagtggctccggtcgaggatgacggctgaatatatgtgntagtttgggatgccagtctgagtggtccgtaggtgttcggcggacgggacaacggcgtacggccgttccgtaggtcaacgcccgaaggtcctcgcccccgtcggtctccg

SEQ ID NO: 335483 - DNA, 515 bp, Homo sapiens
  misc_feature: GZ8MTXP02H2RX6.25.23.C01.1.454.CMB.2.raw
  modified_base (228)..(228): a, c, t, g, unknown or other
  misc_feature (228)..(228): n is a, c, g, or t
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
  modified_base (473)..(473): a, c, t, g, unknown or other
  misc_feature (473)..(473): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaataagtttgtctactggtaccagcagctcccagaaaccggcccccaagctcctcatctataggaatgatcagcggccctnagggatacctgaccgattccctctggctcgaagtctggctcctcggcctccctggccatcagtggctcggtcgnggatgaggctgatatactgtgcagtttgggatgccagtctgagtggtcgacggtgttcggcggagggccaagcngaccgtcctaggtcaagcccgaaggctgccccctcggctccg

SEQ ID NO: 335484 - DNA, 519 bp, Homo sapiens
  misc_feature: GZ8MTXP02HL7QL.25.23.C01.1.454.CMB.2.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagtttgtctactggtaccagcagctcccagaaacggcccccaagctcctcatctataggaatgatcagcggccctcagggatacctgaccgattccctctggctcgaagtctggctcctcggcctccctggccatcagtggctccggtcgagatgaggctgaatattactgtgcagttttgggattgccagtctgagtggtcgacggtgttcggcggagggaccaggctcgaccgtcctaggtcaagcccaaggctgcccctcggtctaccg

SEQ ID NO: 335485 - DNA, 613 bp, Homo sapiens
  misc_feature: GZ8MTXP02IS1R3.25.23.C01.1.454.CMB.2.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggcagagggtctccatctcttgttctgggagcagctccgacgtcggaaattagtttgtctactggtaccagcagctccagaaaccggcccccaagcctcctcatctataggatgatcagccggccctgagggactacctgaccgtattcctctggctacgaagtcgtggcctcccgtcggccctcccgtaggcccagtcgaggtcgggcctccgggtccgaggacgtggacggctagaatagttacgtgtgcgtaggtttgggattcgccagtctggtagtcgggtccggtacgggttggttccggggacgggacggggaacctaacgggtccgttacggtaaccccgttccgtaacggggtccaaccggacccgaaacgggtccctccggtccccccgttcgggttccctacccg

SEQ ID NO: 335486 - DNA, 522 bp, Homo sapiens
  misc_feature: GZ8MTXP02G6Z0O.25.23.C01.1.454.CMB.2.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactgtaccagcagctccagaaacgccccaagcnctcatcataggaatgatcagcggccctcagggataccgtgaccgattcctcgtggctcgaagtctggcctcctcggcctccctgccatcagtggctccggtccgaggntgacggctagaatattactgtncgtaggtttggatgccagtctgagtggtccgtaggtgttcgggcggacgggacaacgctacgaccgtcgtaggcaagcccaaggcctccgcccctcggtcaccg

SEQ ID NO: 335487 - DNA, 589 bp, Homo sapiens
  misc_feature: GZ8MTXP02INDDO.25.23.C01.1.454.CMB.2.raw
  modified_base (200)..(200): a, c, t, g, unknown or other
  misc_feature (200)..(200): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagtttgtctactggtaccagcagctcccagaaaccggcccccaagctcctcatctataggaatgatcagtcgccctnagggatacctgaccgnttcctctggctcgagtctgctcctcggcctccctggccatcgagtcgggccttccggtccgaggatggacggctaggaaatattacgtgttgcgtaggttttgggattggcccagtctggacgttcgggtccgtacgggtgttcggggacgggtagggaacccaaggccgtacggtacccgtacgttacgggtaccaacggacccccgaagggtcccgtaccggccccccgtttcgggtacctacccg

SEQ ID NO: 335488 - DNA, 681 bp, Homo sapiens
  misc_feature: GZ8MTXP02ILX4A.25.23.C01.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagctgtggtagagaagacaggattcaggacaatctccagcatggccggcctccctctcctcctccaccctcctcactcactgtgcagggtcctgggcccagtctgtgctgactcagcccaccctcagtgtcgtcggggacccccggnaggagggtctccatcttcttgttctgggancagctccgacgtacggaaattagtttgtctacgtggtaccagcagcctacccgaagaaacccggcccccaagcctcctacatctataggaatgatcaggccgccctgaggactaccgtgaccgtatttccctcgtcggctacgagttcctgggcccttccgtccggcccctcccgtcggccagtcgagtcgggccctccgggtccgaggacgtggacggtctagtaacttagttacgtgtgtcgttaggttttgggattcggaccgtaggtcgtaggtacggttcgggtaccggtacggggttcgggttacggggacggggaacggggtaaccgtaaacggtcccgttacgggtacccggttacccggttaacgggtacccgaaaccggtacccccggaaacgggtcccgttacccggcccccccgtttacgggttacccctacccg

SEQ ID NO: 335489 - DNA, 521 bp, Homo sapiens
  misc_feature: GZ8MTXP02GX3UV.25.23.C01.1.454.CMB.2.raw
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (515)..(515): a, c, t, g, unknown or other
  misc_feature (515)..(515): n is a, c, g, or t
tcagactgtacagtcacgaccggtgctcgatttagtacacgtgattagggattggggagagaagacaggattcaggacaatctccagcatggcctggtctcctctcctcctcactctcctcgctcactgcacagggtcctgggcccagtctgtactgacgcagccgccctcagtgtctggggccccaggcgagagggtcaccatctcctgcactggggacagttccaatatcggggcaccttataatgttcactggtatcaacaacttccagggacagcccccaaactcgtcattcatgctgataacaatcgtccctnaggtgtccctgaccgattctccccggctccaagtctggcactcagcctcctgtcatcactgggctccagactgagatgaagtgattactatgccagtcctangacaaacncgcctgcgttggtttgtcgttcggcggacgggaccaagggtcgactcgtacaacgtcacggcccaaggcctacgccccctggtaccncttccg

SEQ ID NO: 335490 - DNA, 556 bp, Homo sapiens
  misc_feature: GZ8MTXP02JQA22.25.23.C01.1.454.CMB.2.raw
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctccgtcagtgcttattactggagctggatccgcagtccggcgggagggactggagtggattgggctatatatacgaatggaattaaccacctaccaacccctcctacaaagngtcgagtcccaccatatcagcggacncgtccaagggatcgaggtgtcctgcatctgtacttctcgcgactcgccgcgaccaccggccctatactactgtcgaccagacgtagttcggctgcgtacgtagttttacggagtaattatattctttgtgttcttttagactaagttggtacggggtactaaggggtacgtacggtctacccg

SEQ ID NO: 335491 - DNA, 512 bp, Homo sapiens
  misc_feature: GZ8MTXP02I4IIL.25.23.C01.1.454.CMB.2.raw
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (488)..(488): a, c, t, g, unknown or other
  misc_feature (488)..(488): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgccctgactcagcctgcctccgtgtctgggactcctggacagtcggtcacatctcctgcactggaaccagccgtgacattggtncttataactatgtctctggtccaacaacaccaggcaacggcccccaaactcatcatttangatgtcagtcatcggccctctggtactttctggtcgtcttctctggctccaagtctggcaactcggcctcctgacctatcgtcggggctccgagctgaggacgagctacttattatgctatttnatacaganacaccaanagtctggtcgttcggcggacgggaccaagttcgaccgtctcgtnacgccaacggctcgcccctggtcc

SEQ ID NO: 335492 - DNA, 622 bp, Homo sapiens
  misc_feature: GZ8MTXP02I3437.25.23.C01.1.454.CMB.2.raw
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccgacgtcggaaatagttgtctactggtaccagcagctccagaaaccggccccaagctccncatctatagatgatcagcggccctnagggatacctgaccgtattcctcgtggctcgaagttccgtggccttcccgtccgggcccttccccgtgggaccctatccgacggtcggggtccctcccgggtccggaggatggacggctaggaacttagttacgtgtcgtcgtaggttttgggatcggaccctagtcgtaggtacggttcgggtaccggtacgggttcggttcggggcgggacggggaccaacggcgttacggtacccggtccgtaacggtccgaacggccccgaaacggtccctaccggcccccgttacggtccttacccg

SEQ ID NO: 335493 - DNA, 551 bp, Homo sapiens
  misc_feature: GZ8MTXP02IIOZ2.25.23.C01.1.454.CMB.2.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggccaggactggtgaagccttcggagaccctgtccctcacctgcagtgtctctggtgctcgtcagtgcttatactggagctggatccgcagtccgcgggagggactggagtggattgggcgtatatatacgaatggattaaccaccttacaacccctcctnaaagagtcgagtcccaccatancagcggacncgtcagggatcgaggtcgtcctgctatctgacttctgcgactgccgcggacacggccctatactactgtgaccagagattcggactgacgtacgtattttacggagtaatttattaattctttcgttcgtttcgtttagtacgtaagtggtacggtacggaacggtacggtacggtacgtacg

SEQ ID NO: 335494 - DNA, 573 bp, Homo sapiens
  misc_feature: GZ8MTXP02JTHXF.25.23.C01.1.454.CMB.2.raw
  modified_base (380)..(380): a, c, t, g, unknown or other
  misc_feature (380)..(380): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtggctccgtcagtgcttattactggagctggactccgccagtccggccgggaggggactggagtggagttgggcgtatatatacgaatggattaaccacctaccaacccctcctacaagacgtcgagtccccaccatatcagcggacncgtccagggactcgagtcttccngcatctgacttcngcactgccgcgacaccggccctatactactgtcgccgagagtacgttcggactggacgtacgtagttttcggagttaatttagttacttcgtttgtcgttcgttttgacgtaagttcgggtacggggtacgaaggggtaccggtacggtcgtacccg

SEQ ID NO: 335495 - DNA, 658 bp, Homo sapiens
  misc_feature: GZ8MTXP02FWR7Z.25.23.C01.1.454.CMB.2.raw
  modified_base (351)..(351): a, c, t, g, unknown or other
  misc_feature (351)..(351): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccgggcagagggtctccatctcttgttctgggagcagctccgacgtcggaaatagttgctactggtaccagcagctcccagaaccggccccaagctcctcatctataggatgatcagcggccctgagggatacccgtgaccgtattctcgtggctaccgagtcnggctcctcggcctccgtgccatcgagtcgggctccgggtccgaggntgaggctagaatnttacgtgtgcgtagtttggggattcggccgtagttcgtaggtaggttcgggtccggtacgggtttcgggttaccggggccggggtaaacgggggacccgaaaacggggtccgttaccgggaccccggttaccggttaacgggggttccaaccgggtacccccgaaaggggtccccgttaacccgggtcccccccgttcggggttaccccacccgtttcccgttacccggtttcccccgtaaccccccg

SEQ ID NO: 335496 - DNA, 517 bp, Homo sapiens
  misc_feature: GZ8MTXP02JEB5U.25.23.C01.1.454.CMB.2.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (316)..(316): a, c, t, g, unknown or other
  misc_feature (316)..(316): n is a, c, g, or t
  modified_base (463)..(463): a, c, t, g, unknown or other
  misc_feature (463)..(463): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctggggacccccgggnaggagggtctccatctcttgttccgggancagctccgacgtcggaaataagtttgtctactggtaccagcagctcccagaaacggccccaagctcctcatctataggaatgatcagcggccctnagggatacctgaccgattctctggctcgaagtctggctcctcggccctcctggccatcgagtcgggctccgggtccgaggactggaggctggaattattactgtgctagtttgggatgccagtctgagtgcgacggtgttcggcggnggacagctgacgtcagcagccaggctcgccccgtcggcnctcncgtcccgctcc

SEQ ID NO: 335497 - DNA, 579 bp, Homo sapiens
  misc_feature: GZ8MTXP02H6SSP.25.23.C01.1.454.CMB.2.raw
  modified_base (191)..(191): a, c, t, g, unknown or other
  misc_feature (191)..(191): n is a, c, g, or t
  modified_base (285)..(285): a, c, t, g, unknown or other
  misc_feature (285)..(285): n is a, c, g, or t
  modified_base (354)..(354): a, c, t, g, unknown or other
  misc_feature (354)..(354): n is a, c, g, or t
  modified_base (407)..(407): a, c, t, g, unknown or other
  misc_feature (407)..(407): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggaccccccggnagagggtctccatctcttgttctgggagcagctccgagtcggaaatagtttgctactggtaccagcagctcccagaaaccggccccaagctccncatctatagatgatcagcggccctgagggactacctgaccgtattctctggctccgaagtctggctccncggccctcccgtgccatcaggtcggctccggtccgagatgaggctagaaattnttactgtgctaggtttgggatcgcctagtcgtaggtagtcgggttccggagggttcggtcgggacggggaagggacccgaaggccgttaggacccggttccgtaagggtccacggacccgaaggtccgtcccgcccccgtcggtacaccgttccgttccgttcccccgcccc

SEQ ID NO: 335498 - DNA, 555 bp, Homo sapiens
  misc_feature: GZ8MTXP02JSLJV.25.23.C01.1.454.CMB.2.raw
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtggctccgtcagtgcttatactggagctggatccgcagtccgcgggagggactggagtggattgggctatatatacgaatggattaaccacctacaacccctcctcaaagagtcgagtcccaccatatcagcggacncgtccagggatcgaggtgttccngcatctgacttctgcgactcgccgcggaccaccggccctatacctactgtcgccgagacgtacgttcggactgacgtacgtagttttcggagtatttattactctttgtgtcttttgactaagttggtacggggtaccaaggggtaccgtacgggtctacccg

SEQ ID NO: 335499 - DNA, 567 bp, Homo sapiens
  misc_feature: GZ8MTXP02IYRGE.25.23.C01.1.454.CMB.2.raw
  modified_base (375)..(375): a, c, t, g, unknown or other
  misc_feature (375)..(375): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctccgtcagtgcttattactggagctggatccgccagtccgcgggagggactggagtggattgggcgtatatagtacgaatggattaaccacctacaaacccctcctacaaagagtcgagtccaccatactcagcggaacncgtccaggggactcgaggttcgttcctgctatctgacttctgcgactgccgcgacacggcctatactactgtacgccagagattcggactgacgtagtagttttacggaagttaatttattattcgtttgtgttacgtttttagactaagttggtacggggtaccgaaggggtaccggtacggtctacccgg

SEQ ID NO: 335500 - DNA, 659 bp, Homo sapiens
  misc_feature: GZ8MTXP02HKL04.25.23.C01.1.454.CMB.2.raw
  modified_base (219)..(219): a, c, t, g, unknown or other
  misc_feature (219)..(219): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (413)..(413): a, c, t, g, unknown or other
  misc_feature (413)..(413): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccggagaggtctccatctcttgttcgtgggancagctccgagtacggaaatagttgctacgtggtaccagcagctcccagaaaccggccccaagctccnatcataggatgatcagcgcccctgagggataccgngaccgattctcgnggtctccgaagtcgtggccttccgtccggccctcccgtggaccattccgagtcgggccttacccggcgagagtgacggntagtaaatattacgtggtagtcgtaggtttagggatgtcccgtagtcgtagggtaggtcgggtccggtacgggttcggttacgggggacgggaacggggaacccgaaaggtccggtacggtacccggttaaccgttacgggggtacctacccgggaaccccgaaacggggtcccgtttccccggcccccggttaaccgggtcccctaaccggttcccttccccggttttaaccccccctacccccg

SEQ ID NO: 335501 - DNA, 611 bp, Homo sapiens
  misc_feature: GZ8MTXP02H3JH5.25.23.C01.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (295)..(295): a, c, t, g, unknown or other
  misc_feature (295)..(295): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggnagagggtctccatctcttgttctgggancagctccgacgtcggaaatagttgctactggtacagcagctccagaaaccggccccaagctccncatctataggaatgatcagccggccctcgagggactacctgaccgtattcccgtctcggctcgaagtcgtcgggcttccgtcggccctcccgtggcccattccgagtcggcctccgggtccgaggagtggaggctagaattacgttacgtagtgcgtaggtttggagttcgccgtaagtcgtaggtacggtcggtaccggtacgggtcggttcggggacgggacggggtaaccgaaacggtccgtacggtacccgttaccgtaggtaccgaacggcccgtaaacggccgtaccggcccccgttcggtaccgtcccg

SEQ ID NO: 335502 - DNA, 687 bp, Homo sapiens
  misc_feature: GZ8MTXP02H25TW.25.23.C01.1.454.CMB.2.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggaccccccgggnagnggtctccatctcttgtcgtggancagctcggacgtacggtaaattagtttgtctacgtggaccagcagcctccgaagaaacccggccccaagtctccncactactatagagtagancgacgcgccgcgacggactacgtacgtacgtactctcgtcgtcgtacgtacgtacgtcgtcgtccgtccgtcccgtccgtccgtcctacgtcgtacggtcgggtccgtcccgggtaccgacggtacgtacggacggtacgtagtaacgttaacgttacgttacgttacgtacgttagtttaggttacgttcgtacgtacgttacgtacggtggttacggtaccgggtacgggttcgggttcgggtacgggtaacgggacggtaacggtacggtacggtaccggtaccgtacggtacggaccgtacccgaccggtaccgtcccgtaccccggtacccggtaccgtaccgttacccgttacccgttaccccgtccccg

SEQ ID NO: 335503 - DNA, 644 bp, Homo sapiens
  misc_feature: GZ8MTXP02JS5QY.25.23.C01.1.454.CMB.2.raw
  modified_base (436)..(436): a, c, t, g, unknown or other
  misc_feature (436)..(436): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctcgtggtggctccgtcagtgcttattacgtggagctggactccgccaggtcccggcgggagggactggagtggattgggctatatagtacgaagtggacttaaccacctaccaaccccctcctacaaagtcgtcgagtccccaccatactcacgcggacacggtccgaaggggtactccgaggttcgttcctgcagttctgtactttcngccgactcggcccgcggaccaccggccctattactacgtgtcgaccagacgtgttccgggacttggaccgtagttacgttttacggaacgtttaagtttatttacgttcgttttggttcgttacgtttttaggaacgttaacggttacggggttacgggggacccggtaaaacgggggtacccgtaaaccggggttccgttaccccgg

SEQ ID NO: 335504 - DNA, 607 bp, Homo sapiens
  misc_feature: GZ8MTXP02FP3AX.25.23.C01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (331)..(331): a, c, t, g, unknown or other
  misc_feature (331)..(331): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagttgtctactggtaccagcagctccagaaaccggccccaagctcctcatctatagatgatcagcggcctcagggataccctgaccgtattctntggctacgaagtctggcctccgtcggccttcccgtggccatccgaggtcgggcctcccgggtccgaggtatggaggctagaaattattactggttcgacgtagggttttggggaatcggccgtagttcgtgggtagtcgggtcccgtaggggttggttcggggcgggaacggggaccgaaggccgttacggacccgttccgtaagggtccgaccggtacccgaaggtccctcggccccccttcgggtaccaccgttccgtccgtttcccccgcccc

SEQ ID NO: 335505 - DNA, 552 bp, Homo sapiens
  misc_feature: GZ8MTXP02GVVGT.25.23.C01.1.454.CMB.2.raw
  modified_base (229)..(229): a, c, t, g, unknown or other
  misc_feature (229)..(229): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggcaggagggtctccatctcttgttctgggancagctccgacgtcggaaattagttgtctactggtaccagcagctccagaaaccgcccccaagcctcctcatctataggaatgatcagcggccctcgagggactacctgaccgattccctctggctcgatcnggcctctcggcctccctgcccatcagtggcgtccgtcgnggatgagctagatatactgtgcgtagttggagtgcgacgtcgtgacgtggtcgtcggtggttcgggacggacggggggaccaaacggcgtacggacccgttaccgtaacggtcgaacggacccgaacggcgtccgccccgtccggtctacccg

SEQ ID NO: 335506 - DNA, 665 bp, Homo sapiens
  misc_feature: GZ8MTXP02GZQE5.25.23.C01.1.454.CMB.2.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtctcggggacccccgggnaggagggtcctccatctcttgttctgggancagctccgagtcggaaattagttgctatggtaccagcagctcccataaaccggccccaagctcctcatctataggaatgatcagcggccctgaggataccngaccgtattctctggctccgaagtctggcctccgtcggccctccgtcgccatcgagtcgggcctcccgggtccgaggtacgtggacggtctaggtaaattacgttacgtggttcggaccgttagggttttagggggaacttcggacccgtaagttccgtagggtaacggttcggggtacccggtagggttcgggttacggggacgggtaacggggaccccaaaggtccgtacgggtaccccgttaccgtacggggtaccaccggacccccgaaggtcccgtaaccggccccccgttacgggtacctacccttcccgttaccggttaccccctaccccccg

SEQ ID NO: 335507 - DNA, 691 bp, Homo sapiens
  misc_feature: GZ8MTXP02GQYYU.25.23.C01.1.454.CMB.2.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctggacccagtctgtgctgactcagccaccctcagtgtctcgggaccccccgggnaggagggtctccatctcttgttctgggancagctccgacgtcggaaattagtttgtctactggtaccagcagctacccagaaaccggcccccaagcctcctcatctataggatgatcagccgccctcgagggactaccgtgacccgtattccctcgtggctcgaagtctcgggcctccctcgggccctcccgtggccctagtccgaggttcgggcctcccgggtccgagggagtggacggtctaaggtaattacgttacgtaggtcgacgttaggggttttggggattcgggacccgttaggttccgttagggtagggttccggggttacccggtacgggggtttcgggtttacccggggacgggggtaacggggtaccaaacgggttccgttacggaaccccggttacccggttaagggtacccgaaccggacccccgtaacgggtcccgtacccggtccccccgtttccggggttcccttaccccgg

SEQ ID NO: 335508 - DNA, 651 bp, Homo sapiens
  misc_feature: GZ8MTXP02G298X.25.23.C01.1.454.CMB.2.raw
  modified_base (230)..(230): a, c, t, g, unknown or other
  misc_feature (230)..(230): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggcagagggtctccatctcttgttctgggancagctccgacgtcggaaattagtttgtctactggtaccagcagctccagaaaccgcccccaagctcctcatctatagatgatcagccgccctgaggactacctgaccgtattcctctggctcgaagtctggcctccgtcggccctcccgtggccagtcgagtcgggcctccggtaccgaggactggacggctaggaacttattacgtggtgcgttaggtttgggacttggacctagttcgtggtacggttcgggtccgtacggggttcggttaccggggacgggtaacggggaaccgaaacggtccggttaccggtaaccccggttccgtaacgggggttacccaaccggggtaacccccgaaacgggggtccccttacccgggtacccccccgtttaccggggttcccgtttaacccccg

SEQ ID NO: 335509 - DNA, 726 bp, Homo sapiens
  misc_feature: GZ8MTXP02HD2R6.25.23.C01.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (324)..(324): a, c, t, g, unknown or other
  misc_feature (324)..(324): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaatagtttgtctactggtaccagcagctcccagaaaccggccccaagctcctcatctataggaatgatcagcgccctgaggatacccgngaccgtattctctggctaccgaagtctggcctccgtccggccctcccgtcggccagtccgaggtcggggcctcccgggtaccgaggtacgtggacgggtctaggtaaacttacgttaacgttggtaggtacgttaggggtttttaggggacgttcggtcccgtaggttccgtaggggtaggttccggggtacccgggtacgggggtttcgggtttaccgggggacggggtaaacgggggacccgtaaaacggtccggtacggtaaaccccgggttccggttaaaggggtcccgtaccggggaacccccggaaacgggccccgttaacccgggtacccccccgttacgggggttaccctaccccggtttcccgttaccccgggtttcccccccggtccccccg

SEQ ID NO: 335510 - DNA, 630 bp, Homo sapiens
  misc_feature: GZ8MTXP02ISN3D.25.23.C01.1.454.CMB.2.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (413)..(413): a, c, t, g, unknown or other
  misc_feature (413)..(413): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtcgtcgggaccccccgggnagagggtctccatctcttgttctgggancagctccgacgtcggaaataagtttgctactggtaccagcagctccagaacgccccaagctcctcatcataggatgatcagcggccctgaggactacctgaccgtattcctctggcctacgagtctcggcctccgtccggccctcccgtcggccagtcagtcgggcctccgggtccgaggntaggcggtactaggtaaattagttacgtggttcgaccgttagggtttaggacttcggaccccgtagttccggtaaggtggttcgggtcccggttacgggttggttcccggggacgggggtaacggacccgtaacggggtcttacgggacccgttacggtacggtaccgaacggaccccgaacggtcccgtcccggaccccttcgggtaccttacccg

SEQ ID NO: 335511 - DNA, 508 bp, Homo sapiens
  misc_feature: GZ8MTXP02I2OT3.25.23.C01.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctcgggacccccggnaggagggtctccatctcttgtctgggancagctccgacgtcggaaattagttgctactggtaccagcagctcccagaaaccggccccaagcncctcatcatagatgatcagcgccctnaggataccngaccgattccnctgctacgaagtctgctcctggcccttccgagccatcagtggctccggcgagatgagctagatattactgngctagttggatgccagtcngagtgtaccggngtgtcggaggacggacaagcgtacgaccgtcgtagcaacgccgacggccaccgtccccgtcgacctcg

SEQ ID NO: 335512 - DNA, 629 bp, Homo sapiens
  misc_feature: GZ8MTXP02G5V4C.25.23.C01.1.454.CMB.2.raw
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctccgtcagtgcttatactggagctggactccgcaggtccggcggggagggactggagtggattgggctatatatacgaatggattaaccacctaccaacccctcctacaaagcgtcgatccacatactcagcgacncgtcagggatcgaggtcgttccngctatcgtcgtacttcgtcgtacgtacgtcggcccggaccgggaccgaccggtaccctactaccgtacgtcgtacgaccgaagacgtacgttacggacgtacggtacgtacgtttacgttttacggaaacgttaagtttactttacgtttcgtttacgttcgttacgtttacgtacgtaaggttcggggtacggggtaccggtaaacggggtaccggtaccggttaccgtacccg

SEQ ID NO: 335513 - DNA, 451 bp, Homo sapiens
  misc_feature: GZ8MTXP02H9RIA.25.23.C01.1.454.CMB.2.raw
  modified_base (445)..(451): a, c, t, g, unknown or other
  misc_feature (445)..(451): n is a, c, g, or t
tcagactgtacagtcacgaccggtgctcgatttagtacacgtgattagggattgggcgtatatatacgaatggattaaccacctacaaccctccctcaagagtcgagtcaccatatcagcggacacgtccagggatcaggtgttcctgcatctgacttctgcgactgccgcggacacggccctatactactgtgccagagattcggactgcgacgtattttttcggagaatttattatcttttgtgtcttttgacatggtggggccaagggacgacggtcaccgtctcttcagcctccaccaagggccccatccggtccttccccctggccacccctcctccaagacgccacctcgtgggggcacgacggcccggcctggggctggcctggtcaggacttactccactgtaccagtctgacgcgggcgtggcgaaggcgcatagnnnnnnn

SEQ ID NO: 335514 - DNA, 564 bp, Homo sapiens
  misc_feature: GZ8MTXP02GI4HG.25.23.C01.1.454.CMB.2.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (398)..(398): a, c, t, g, unknown or other
  misc_feature (398)..(398): n is a, c, g, or t
  modified_base (538)..(538): a, c, t, g, unknown or other
  misc_feature (538)..(538): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccacctcagtgtctgggacccccggnagagggtctccatctcttgttctgggancagctccgacgtcggaaattagttgtctatggtaccagcagctcccaagaaaccgcccccaagctcctcatctaataggaatgatcagcgccctgagggataccgtgaccgtattcntggctcgagtcnggctcgtcgcctccgtgcatcgagtcggctccggtcgagatgagctagaatnttacgtgtgactaggtttgggatcggcctagtcgtaggagtcggtcccggaggttcggtcgggcggaacgggacaagtcgtacgacccggtctacgggtcacggaccccgaaggtccgtccgtccccccgtgggtacccnccgttccgtccggttacccctccccc

SEQ ID NO: 335515 - DNA, 598 bp, Homo sapiens
  misc_feature: GZ8MTXP02F4L31.25.23.C01.1.454.CMB.2.raw
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggaccccaggcgagagggtcaccatctcctgcactggggacagttccaatatcggggcaccttataatgttcactggtatcaacaacttccagggacacgcccccaaactcgtcattcatgctgataacaatcgtccctnaggtntccctgaccgattctccggcctccaagtctggcacctcncgccctccctgtccatcacgtgggcctcagactgagatagaaaggtgaatttacactcgacctacgtccctatcgaccaaacgcgtcccgtgtccggttgggttttggtccgtttccggggcgggtccggggtaacccgtaagggttcgaccgttaccggttacccgtaagttccgacggacccgaaagggtccctaccggcccccgttcggtcctacccgttccgtttcccccg

SEQ ID NO: 335516 - DNA, 628 bp, Homo sapiens
  misc_feature: GZ8MTXP02GZI0M.25.23.C01.1.454.CMB.2.raw
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggcaggagggtctccatctcttgttctgggancagctccgacgtcggaaatagtttgtctactggtaccagcagctccagaaccggccccaagctcctnatctataggaatgatcacgccgccctgagggactacccgtgaccgtattctcgtggctaccgagtctcggcctccgtcgcctcccgnggaccactcgaggtcgggcctccgggtaccgagggtactggacggcgtagtaattacgttagtcggtgacgttaggtttgggattcggccgtagttcgtagggacgttcgggtacccggtaggttcggggtccgggacgggacgggtaaccaacggtcggtacggtaccgtcggtacggtcgaaccggacccgaacggtcctaacccggcccccgttacggtccctaccgttccgtcccggttcccctaccccg

SEQ ID NO: 335517 - DNA, 580 bp, Homo sapiens
  misc_feature: GZ8MTXP02IJF3C.25.23.C01.1.454.CMB.2.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgtctgggancagctccgagtcggaaattagtttgctactggtaccngcagctccagaacgccccagcnctcatcatagatgatcagccgccctgaggactcccagaccgatttcctctcggctccccagctacaacggaaacacacgtcttcctgaccatcgacgtggggctacgaggacggaagagtggacgctagtacttattacgtcgttcccgtaccggacaccgtagtaggtaacgcgtacgggttgtcggtcgttcggcgggtagggaccgtaagggtcgtaccgttacgtacgggtcgacggccgtaacggccgtccgtcccccgtcggtctaccgttcctccgtcccctacccgtaccctccg

SEQ ID NO: 335518 - DNA, 724 bp, Homo sapiens
  misc_feature: GZ8MTXP02H920H.25.23.C01.1.454.CMB.2.raw
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtcccctcacctgcagtgtctctggtggctccgtcagtgctttattactggagctggactccgccaggtcccggccggggaggggactgggagtggagttgggcgtatatatacgaatggacttaacccacctacaaccccctcctacaagacgtcgacgtcccaccatactacagaccggacaccgtccgaagggactcgtaggttcgttccctgcctagtcgtcgtacctttcgcgtaccgtaccgtcggacccggaccgggacccgaaccccggggtaccccttaacttacccgttacgttcggttacgacccgtaaggtacggtacgtttaccgggaacgttcggtacccggtacggtttaacgttttacggggaaagttaaactttttagtttaaactttccggttttagttacgtttcgttttttacggaccgttaaggtttcgggtaccggggggtaacccggtaaacgggggtacccggtaaccgggtttacccgttaacccccggg

SEQ ID NO: 335519 - DNA, 611 bp, Homo sapiens
  misc_feature: GZ8MTXP02FRWRY.25.23.C01.1.454.CMB.2.raw
  modified_base (337)..(337): a, c, t, g, unknown or other
  misc_feature (337)..(337): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctggggacccccggcagagggtctccatctcttgttctgggagcagctccgacgtcggaaataagtttgtctactggtaccagcagctccagaaacgccccaagctcctcatcatagaatgatcagtggccctgagggatacctgaaccgtnttccctcgtgctacgagtcgtcggcctccgccggtccctcccgtcgcctatcgtaggtcggtcccgtcccgggtacgaggagtggacggtacgtagtaaattacgttacgtgtgtacgtagggtttggattcgacgtagtcgtaggtacggtcgggtaccggtagggttcgggtccgggacgggtacgggaccgaacggccgtacggtacccgtaccgtaacggtaccgaaccggacccgtaacggtcccgtccgacccccgtcggtacctccg

SEQ ID NO: 335520 - DNA, 600 bp, Homo sapiens
  misc_feature: GZ8MTXP02IDT44.25.23.C01.1.454.CMB.2.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgccctgactcagcctgcctccgtgtctgggactcctggacagtcggtcacatctcctgcactggaaccagccgtgactattggtgcttaataactatgtctcctggtcccaacaacaccagcaacggcccccaaatcatcatttatgatgtcagtcatccggcctctggtagtttcctggtcgtcttctcgtcggctccagtctcggaccaaccgtcggccctccctcgaccctactccgtcggggtacctcccgaaggccgtaggaacgggacggacggtcttaactttactttattacgtcttactttcaattaaccgaggaacaccaaaccaactaagtcgtgggttacggttcgggcgggaacggggtaacctaaacggttcggtacccgttcccgtcggtcgacgacccgtacggcctccggtccccgtcggtcc

SEQ ID NO: 335521 - DNA, 585 bp, Homo sapiens
  misc_feature: GZ8MTXP02IAGA4.25.23.C01.1.454.CMB.2.raw
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggcctactcccagatgggtcctgtcccagatgcacctgcaggagtcgggcccaggactggtgaagccttcggagaccctgtccctcacctgcagtgtctctggtgctcgtcagtgctttattacgtggagctggactccgccaggtccggccggggaggggactggagtggagttgggngtatatatacgaatggattaaaccactacaacccctcacaagactcgatcccacatancagcggacncgtccaagggntcgaggttcgtcctgccatctgtactttcngcgactcgccgcggacacggccctagtaactacgttgtcgaccaagagtacgttacggactggaccgtaacgttacgtttttacgggaattaatttattagtttctttcgtgttctttttagactaagttggacggggacgtaaagggccggtaacggttccgaccg

SEQ ID NO: 335522 - DNA, 677 bp, Homo sapiens
  misc_feature: GZ8MTXP02FKEZ5.25.23.C01.1.454.CMB.2.raw
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctggggaccccccgggnaggnggtctccatctcttgttctgggancagcctccgacgtacggaaattagtttgtctactggtaccagcagcctcccaacggaaacccggccccaagtcctcctacatctataggaatgatcgagccggccctgaggtactaccgtgaccgtattcctcgtggctacggaagtcgtcggtcctccgtccggtcccttcccgtcgcctatcgtacggtcgggtcccgtcccgggtaccggaggtagtacggacggtactaaggtaattaacgtttacgttggttcgtacggttagggtttaggggtagtcggtaccgtacggttcgttagggtacgggttcgggtaccgggtacgggttcgggttcggggtacggggaacggggtaaccgaacggtccggtacggtacccggttaccgtacggtaccgaaccggtacccgaacggtccgtccggcccccgttcggtacctaccg

SEQ ID NO: 335523 - DNA, 645 bp, Homo sapiens
  misc_feature: GZ8MTXP02JJW30.25.23.C01.1.454.CMB.2.raw
  modified_base (386)..(386): a, c, t, g, unknown or other
  misc_feature (386)..(386): n is a, c, g, or t
  modified_base (429)..(429): a, c, t, g, unknown or other
  misc_feature (429)..(429): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtcccctcacctgcagtgtctctggtggctccgtcagtgcttattacgtggagcgtggactccgccaggtccggccggggaggggactgggagtggagttgggcgtatatagtacgaatggaattaaccacctaccaacccctcctacaaagcgtcgatcccaccatatcagcggacncgtccgagggactcgaggttcgtcctgctatctcgtacttcgngacgctcggcccgcggaccaccggtaccctatacgtacgtgtacgaccgagtaacgtacgttcggaacgttcggaccggttaaacgtttagtttttacccggggaaatttaattttaagtttacttcgtttttaggtcgtttcgtttttaggacttaaggtttgggtaccgggggtaaccgaaagggggtacccgttacggggttacctaacccgg

SEQ ID NO: 335524 - DNA, 570 bp, Homo sapiens
  misc_feature: GZ8MTXP02F06WK.25.23.C01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (307)..(307): a, c, t, g, unknown or other
  misc_feature (307)..(307): n is a, c, g, or t
  modified_base (468)..(468): a, c, t, g, unknown or other
  misc_feature (468)..(468): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaattagttgtctactggtaccagcagctccagaacgccccaagctcctcatctataggatgatcagcgccctnagggctacctgaccgtattcctgtggctccgagtctggctcctcggccctccgtggccatcagtcggctccggtcgaggatgaggctagatattacgtgtgcgtaggtttgggattcgccgtagttctggaggttcgggtccggtagggttgggttcgggngggacgggacaaggtcgtacggacccggtctagggtaccacggacccgaacggccgtcccggcccccgttacggtcctacgtccgtccgttcccccgtcccc

SEQ ID NO: 335525 - DNA, 599 bp, Homo sapiens
  misc_feature: GZ8MTXP02GX7BH.25.23.C01.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (334)..(334): a, c, t, g, unknown or other
  misc_feature (334)..(334): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaatagtttgtctactggtaccagcagctccagaaaccggccccaagctcctnatctanagaatgatcagccgccctgaggactcccagaccgattctcnggctccccagctacgaaggaaacacgacgtcctttcctagacccattccgacgtggggcctcgaggacggaagagtggaggtactagtaactttacgttaacgtcgtttcccgtacccgggactaacccgtaggttacggtaaagtcgtagggttgtcggttcgttcgggacgggacgggacgtaaacgggtcgtacccggtcgtaggtcacggaccgacggcctccgccccgtcgtacacctctccgtaccctaccctctaccg

SEQ ID NO: 335526 - DNA, 562 bp, Homo sapiens
  misc_feature: GZ8MTXP02I6G3Z.25.23.C01.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (332)..(332): a, c, t, g, unknown or other
  misc_feature (332)..(332): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaatagttgtctatggtaccagcagctccagaaccggccccaagctcctcatctataggaatgatcagccggccctcgaggactcccagaccgattcncgtggctcccagctacaaggaaacacacgtccttccttagaccatcacgtgggctacgaggcgaagntggagctagacttatactcgttccncccgggacaccgaggtggtacgcgtaggttcgtggttcgtcgggcggacggacgtaacggtcgaaccgtcgtaggtccagcccgaggtccctaccggccccgtcggtcaccttcgtccgtaccctacccgtcctaccg

SEQ ID NO: 335527 - DNA, 772 bp, Homo sapiens
  misc_feature: GZ8MTXP02J36PN.25.23.C01.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (378)..(378): a, c, t, g, unknown or other
  misc_feature (378)..(378): n is a, c, g, or t
tcagactgtacagtcacgaccggtgctcgatttagtacacgtgattagggattggggagctgtggtagagaagacaggattcaggacaatctccagcatggccggccctccctctcctcctccacccctcctcactcactgtgcaggtcctgggcccagtctgtgctgacctcagcccaccctcagtgtcctcggggacccccgggnaggaggtcctccatctcttgtctgggancagcctccgacgtacggtaaattagtttgacttactggtaccagcacgcctaccccgaagaaacccggcccccaagcctcctcatctaagtaggatgaatcaacgccgccctacgagggtactaccgtcgaccgtatttcccncgttcgctacggtaacgtccgttcgggccttcccgtccggccccttcccgtaggccctaagttccgacggttcggggacccgttccgggtacccggaagggattacggggaacggtccttaaggtaaactttaaacgtttaccgtggttacgtaccggttaaggtttttacgggggacttcgggccctaagggttccgttgggtaacgggttaccgggggttcccggtaacgggggttcgggtttaccgggggaccgggaaacgggggtaaacccaaacgggtcccgttaccggtaaaccccggttccgttaaacggtcccgaaccggtacccccgaaagggtcccccgttaccccggtccccccccgtttaacggtccccttttaacccccgg

SEQ ID NO: 335528 - DNA, 646 bp, Homo sapiens
  misc_feature: GZ8MTXP02JE24Z.25.23.C01.1.454.CMB.2.raw
  modified_base (190)..(190): a, c, t, g, unknown or other
  misc_feature (190)..(190): n is a, c, g, or t
  modified_base (323)..(323): a, c, t, g, unknown or other
  misc_feature (323)..(323): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaaattagttgtctactggtaccagcagctccagaaccggccccaagctcctcatctataggaatgatcagcggccctgagggactaccngaccgtattcgtctggctccgaagtcgtgccttccgcggtccctcccgtggccagttccgaggtcgggtcctcccgggtcccggaggtacgtcgggaaggtcgtagtaaacttacgtttaacgtggtgacgttaggtttacggggattcggaccgtaggttccgtagggacggttcggggtcccgtaggggttcggttcggggacgggtaacgggaccgaaacggtccgtacggtacccggttaccgtaggtaccacgggaccccgtaggtcccgtccgtcccccgtacggtacctaccgttcccgtccgttccccgtccccg

SEQ ID NO: 335529 - DNA, 671 bp, Homo sapiens
  misc_feature: GZ8MTXP02HMQHO.25.23.C01.1.454.CMB.2.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagactgtacagtcacgaccggtgctcgatttagtacacgtgattagggattggggagagaagacaggattcaggacaatctccagcatggccggcctccctctcctcctcacccctcctcactcactgtgcagggtcctgggcccagtctgtgctgactcagccaccctcagtgtctcggggacccccggnagaggtctccatctcttgttctgggancagctccgacggtacggaaattaagtttgtctacgtggtaccagcagcctcccagaaaccggccccaagctcctcatctagagatgatcaggccgccctgagggactcccgagccgtacttcctcgtggcctaccccgacgctacaaacggaaacacacgtcctttcctgaccctatccacggttggggacctacgacggacggaagaggtgaacggtctacgtactttaattaccgttacggttaccccgtacccgggaactaaccggtacgttaggggaaacgtaccggttagggttggttacgggttccggttcggggacgggtaacgggtaaccggtaaagggtccgggtaaacccgttcggtacggtacaacggtacccgaacggtccgtcccgtcccccgtaaggtcctaccgttcctccgtttaccccctccctttccgtaccg

SEQ ID NO: 335530 - DNA, 576 bp, Homo sapiens
  misc_feature: GZ8MTXP02IFXYW.25.23.C01.1.454.CMB.2.raw
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (432)..(432): a, c, t, g, unknown or other
  misc_feature (432)..(432): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagcccttcggagaccctgtccctcacctgcagtgtctctggtggctccgtcagtgcttattactggagctggatccgccagtccgccgggaggggactggagtggattgggcgtatatatacgaatggattaaccnctaaccaacccctcctacaagngtcgagtcccaccatactcacgcggacacgtccaggggctcaggttgtcctgcatctgacttctgcgactcgccgcggacnccggacctatactactgtacgccagacgtattcgggacttggcgtagttactttttcgggaattaatttatttagtttcgtttgttgttctttttgactaagttggttacggggacccgtaaggggcgtaacggtcgtacccgg

SEQ ID NO: 335531 - DNA, 787 bp, Homo sapiens
  misc_feature: GZ8MTXP02G7VLW.25.23.C01.1.454.CMB.2.raw
tcagactgtacagtcacgaccggtgctcgatttagtacacgtgattagggattggggagctgtggtagagaagacaggattcaggacaatctccagcatggccggcctccctctcctcctccaccctcctcactcactgtgcagggtcctgggcccagtctgtgctgactcacgccaccctcagtgtctcgggacccccggaggaggtctccatctcttgttcgtgggagcagctccgacgtacggaaattagttgtctactggtaccagcagcctaccgaacggaaacccggcccccaaagcctcctacatactaataaggaaatggaactccgaacggcccggtacccctacggaaacggggtacttaaccccgtggaaaccccgttatttccccgttaccggtcggtccttaaccgggtaaacggtttccgttacggggtcccctttcccccggttcccgggtaccccctttcccccgttcgggacccctaacgtttccgaaacggggttcggggtaccccgttcccgggggttacccgggaagggtaacgttagggaacggggtccttaaagggtaaaacctttaagtttaaccgttggtacggtacgtttaagggtttttcgggggaatttcgggaccctaaggttccgtaggtacggttacggggtcccggtaaggggttcggttacggggacggggtaacggaccaaacggccgtacggtacccgtaccgtaggcccgaacgacccgaacggcccgtcccgtccccgtcggtacctcccg

SEQ ID NO: 335532 - DNA, 686 bp, Homo sapiens
  misc_feature: GZ8MTXP02FRGK5.25.23.C01.1.454.CMB.2.raw
  modified_base (225)..(225): a, c, t, g, unknown or other
  misc_feature (225)..(225): n is a, c, g, or t
  modified_base (325)..(325): a, c, t, g, unknown or other
  misc_feature (325)..(325): n is a, c, g, or t
tcagactgtacagtcacgaccggtgctcgatttagtacacgtgattagggattggggagctgtggtagagaagacaggattcaggacaatctccagcatggccggcctcccctctcctcctcaccctcctcactcactgtgcagggtcctgggcccagtctgtgctgactcagccaccctcagtgtctgggaccccggcagaggtctccatctcttgttctggancagctccgacgtcggaaattaagtttgtctactggtaccagcagctcccagaaaccggcccccaagcctcctcatctataggaatgatcagccggccctnagggactaccgtgaccgtattccctcgtggctcgaagtctggcctcctcggcctcccgtgccatcagtcgggcctccgggtccgaggatggacggctagaattattacgtggttagcgttaggttttaggggacttcggacccgtaggttccgttagggtaacgggtttcggggttacccgggtaacgggggtttcgggtttacccgggggacggggtaaaccgggggaacccgtaaaacgggtccgttaccggtaaccccggtttacccggttaacgggttacccgaaaccgggtcccccgaaaacggggtcccgttaccccggtacccccccggttcccggggttccctttaacccccg

SEQ ID NO: 335533 - DNA, 556 bp, Homo sapiens
  misc_feature: GZ8MTXP02JAYAX.25.23.C01.1.454.CMB.2.raw
  modified_base (191)..(191): a, c, t, g, unknown or other
  misc_feature (191)..(191): n is a, c, g, or t
  modified_base (535)..(535): a, c, t, g, unknown or other
  misc_feature (535)..(535): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctggggacccccggnagagggtctccatctcttgttctgggagcagctccgagtcggaaataagttgtctactggtaccagcagctcccagaaacggccccaagctcctcatctataggatgatcagcggccctcagggactacccgtgaccgtattctctggctccgaagtctgctcctcggcctccctggccatcgagtcgggctcccgggtcgagatgagcgtgaattattacgtgtgcgtagtttgggatgccagtctggtagtcggtcgacgggttggttacgggcgggtagggaccaaggtcgtcggaccgtccgtaggtcgacgcccgaaggccgtcgcccccgtcggtccncttccgtcgttccccgtcccc

SEQ ID NO: 335534 - DNA, 761 bp, Homo sapiens
  misc_feature: GZ8MTXP02F47TL.25.23.C01.1.454.CMB.2.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtcgtcggggacccccggnaggacgggtctccatctcttgttctgggancagctccgacgtacggaaattagtttgtctactggtaccagcagcctaccgaacgaaccggccccaagcctccctcacttctaagtaaggaattgaactcgacgtccggaccctacgacggggaactacccgtaggacccgttatttccgtccgtggtccttaccggtaacgttccgtcggtcccttcccgtcccgggtccttcccgtcgtacgggtccctaagttcgacgggttccggggccccgttcccggggtacggaggtaacggtcgggtaggtaccgttaaagaacgtttacgttaaccggttgtcggtacgttaaggggttttcggagttccggtacgttacggtcgttagggtacgggttccgggttccgggtaacggggtttcgggttaccgggggaacggggttaccggaaacccgtagggtcccgttaacggggtccccgttacggtaaaccggctaaaaccccgggcctaacggtcccgtaccccgcccggttacgtccgtaccttcggtcccccgtttaaccccc

SEQ ID NO: 335535 - DNA, 690 bp, Homo sapiens
  misc_feature: GZ8MTXP02JISD9.25.23.C01.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtggctccgtnagtgtcttattactggancgtggactccgccagtcccggccggggagggactggaggtggagttgggntaatatatacgaatggaacttaaccacctaacccaccccttcctacaaagngtacgagtcccaccatactcaggaccggtacaccggtccgaaggggtactcgagggttctttacccgngtactacttcgtacgtacttcgtacgtccgtaccgtcggcccggaccgggacccgtaccggtacccttaacgtaccgttacgtcgtaccggaccgtaaggtaacgtacgttccggtacgtcggtaccgttaacggtttagttttacggtaaagtttaactttacgtttaacgtttgtttacggttcgtttacgtttacgacgttaacggttcggggtaacggggtaccggtaacgggtaccggtaccggtaccttacccg

SEQ ID NO: 335536 - DNA, 656 bp, Homo sapiens
  misc_feature: GZ8MTXP02JO9KZ.25.23.C01.1.454.CMB.2.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtctcggggacccccggnagagggtctccatctcttgttctgggancagctccgacgtcggaaattagttgtctactggtaccngcagctccagaaccgccccagctccncatctanaggatgatcgagcggccctgaggactaccgtgaccgtattccgtcgtggtcctacggaacgtctcggccttccgccggtccctcccgtggccacgttcgagggtcgggccgttcccgggtaccgaggtagtggaacggcttagaaactttcgttacgtggtacgtacgttaggtttacggggactcggacccgtagtcgtagggtacggttcggtacccggtaggggttcggtccggggacggtaacggggaccaaggtccgttacgggacccgtacgtacggtaccgaccgaccccggtaaggtcccgtaaccggttcccccgtcggtacctacccgttccgttcccggtaccccctcccccg

SEQ ID NO: 335537 - DNA, 643 bp, Homo sapiens
  misc_feature: GZ8MTXP02GE3T0.25.23.C01.1.454.CMB.2.raw
  modified_base (192)..(192): a, c, t, g, unknown or other
  misc_feature (192)..(192): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtctcgggacccccggnaggagggtctccatctcttgttcgtgggagcagctccgacgtcggaaattagtttgtctactggtaccagcagctccagaaccgccccagctcnanctanaggatgatcgagccggccctagacgggactccccgagacccgtattcctcgtcggcctccccagtcctacgaacggaaacaccagtcctttacctacgaacctatccgacggtcggggacctacgagggaccggaagacgtggaaggtctagtaacttacgttaccgtacgttccccgtacccgggactaccgtaggttaggaacgtggtaggttgtcggtcgttcggggacggacgggaacgtagggtcgtacccggttcgtagggtccgaccggacccgaacggtccctacccgtcccccgtcggtacctaccgttcccgtaccgttcccccgtacccgttccctaccg

SEQ ID NO: 335538 - DNA, 634 bp, Homo sapiens
  misc_feature: GZ8MTXP02H8TGW.25.23.C01.1.454.CMB.2.raw
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (423)..(423): a, c, t, g, unknown or other
  misc_feature (423)..(423): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggcctactcccagatgggtcctgtcccagatgcacctgcaggagtcgggcccaggactggtagaagccttcggagaccctgtcccctcacctgcagtgtctctggtgctcgtnagtgctttattactgganctggactccgcaggtccggccggggaggggactgggagtggattggggctatatatacgaatggaacttaaacccacctaaccaaaccccctctacgaaagacgtcgatcccaacctatactcaggccggacacgtccaagggtctcgagggttcttaccngactatctcgtacttcgcgtacgtacgtcgccggacgaccaccggtaccttatacctacgtgacgacgagtacgtacgtacgacgtcgtacgtacgtttacgttttacggaacgttaattttatttacgtttcgtttacgtttcgtttacgtttacgtacgtaagttacggtacgggtacggtaaacgggtaacggtacggtaccgtaccg

SEQ ID NO: 335539 - DNA, 550 bp, Homo sapiens
  misc_feature: GZ8MTXP02I6CGR.25.23.C01.1.454.CMB.2.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagtttgtctactggtaccagcagctcccagaaaccggcccccaagctcctnatctataggaatgatcagcggcccctgagggactacctgaccgtattccctctggctcgaatccgtggcctcctcgggcctcccgtaggccatcagtgggcctccggtccgaggacgtggacggtctagaaattagttaactggtgcagcagtgggatgacagctagattggtgttggtttcggcggtaagggacgaaagtcgtcgaccgttcgaaggtcgacggcccaaagggcctccggccccttcggtcc

SEQ ID NO: 335540 - DNA, 639 bp, Homo sapiens
  misc_feature: GZ8MTXP02H280V.25.23.C01.1.454.CMB.2.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
tcagactgtacagtcacgaccggtgctcgatttagtacacgtgattagggattggggagagaagacaggattcaggacaatctccagcatggccggcctccctctcctcctcacccctcctcactcactgtgcagggtcctgggcccagtctgtgctgactcagccaccctcagtcgtcgtcggggacccccggnaggaggtcctccatcttcttgttctggagnagctccgacgtacgaaatagtttgtctagtgaccngcagctccgagaaccgccccaagctcncatcanagatnatcgagccgtcctgaggactacgtgacgtnttctcgtgactacgagtcgtcgctccgtccgtccctccgtcgaccatccgagttcgggccttcccggggtaccgaggtattcggacgatacgtaaattacgttgtacgtgtacgtaaggtttggatcgaccgttagtcgtaggtcggtcgggtaccgggtgggtttcggtacggggacgggtaacgggtaccaaggtccgtaccggtacccgttacggttacggaccaaccggcccgtaacggtccccgttaacccggtcccggtaccgttcccgtaacgtttccccggttcccttaaaccccgtcccccg

SEQ ID NO: 335541 - DNA, 861 bp, Homo sapiens
  misc_feature: GZ8MTXP02G7NQ9.25.23.C01.1.454.CMB.2.raw
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtcccctcacctgcagtgtctcgtggtgctccgtcagtgtcttattacgtggagtcgtggacttcccgaccacggtccccggccggggaggggtacctggggaggttgggtagttgggggacttaataagttaagtaaccggtaaagttaggtaaccttttaaaacccccaaccccgtttaaaccccgaaaccccccctttacccgtaccgaaaacggtaccggtaccggtaacggttacccccaaccctaattacgtaccgaagggcccggaacctaccggggtccccggaaagggggtaccttaccgtaagggggtttccgttaccccgtaggtacctacgtttaccgttacggtaaccgttttccgcgggtacccggtaccgttccggggacccccgggaaccgggttaacccgaccggggtaacccttaacgtttaaacgttacccgttaacgtttccggtacggacccgtaagggtaacgttacggttacgggacttcgggaccgttaacggtttacgtttttaacgggaagtttaaactttagtttacgtttcggttttacgtaccgtttacgttttagaaccgtttagggttacggggtttcgggggaaacccgtaaacgggggttacccggtacggttaccccg

SEQ ID NO: 335542 - DNA, 614 bp, Homo sapiens
  misc_feature: GZ8MTXP02FITCJ.25.23.C01.1.454.CMB.2.raw
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggcagagggtctccatctcttgttctgggagcagctccgacgtcggaaataagtttgtctactggtaccagcagctcccagaaaccggcccccaagctcctcatctatagaatgatcagcgccctgagggactacctgaccgtattccctcgtggctcgaagtctggcctcctccggcctcccgtggccatcaggtcgggccctccgggtccgagggtatggacgggtctaggtaaattagttacgttgtagtcgtagggttttgggattcggactacgttcgtaggtaggttcgggtacccggtagggtttcgggttacggggacgggtaacggggaaccaaacggctacggtacccgtaccgtaggtaccaacggacccgaacggtccgtcccggcccccgtcgggtacctacccg

SEQ ID NO: 335543 - DNA, 552 bp, Homo sapiens
  misc_feature: GZ8MTXP02IUICX.25.23.C01.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaattagtttgtctactggtaccagcagctcccagaaccggccccaagctcctcatctataggatgatcagcggccctgagggactacccgtgaccgtattcctctggctcgaacgtcgtggcctccgtcggccctccgtggcccatccgagtgggcctccggtcgaggtntgaggctagaatnttactgtgactaggtttgggatcggacctagtctggagtcggtccgaggtcgttcgggcggaggtaccaagcgtgaccgtcgtaggcacgacccgaggtcctcgccccttggcctactccgtcgttccccgccc

SEQ ID NO: 335544 - DNA, 696 bp, Homo sapiens
  misc_feature: GZ8MTXP02I49H7.25.23.C01.1.454.CMB.2.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnaggagggtctccatctcttgttcgtgggancagcctccgacgtcggaaataagttntctactgtaccagcagctcccagaaccgccccagctcctnatcatagatgatcagccgccctgacggactaccgngtaccgtattccgtcgtcgcctacgaagttcctacgggtcctcccgtccgggtccccttccccgtcgggccctacgtccgtacgggtcggggtccctcccggggtaccgaaggggtacgttcggaaccgggttcgtaagtaaacgttagttacgtacggttcgtacggtttagggtttacgggacgttacggaccgttaggttcggtagggttacgggttccgggttaccgggttacggggttcgggtccggggtaacgggacgggaaccgtacggtaccggtaccggtacccggttaccgtacggtacccgaaccggtacccgtaacggtacccgtccccgtcccccggttacgtacctaccg

SEQ ID NO: 335545 - DNA, 661 bp, Homo sapiens
  misc_feature: GZ8MTXP02F9Z6B.25.23.C01.1.454.CMB.2.raw
  modified_base (219)..(219): a, c, t, g, unknown or other
  misc_feature (219)..(219): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcgggacccccggcagagggtctccatctcttgttctgggancagctccgacgtcggaaattaagttgtctactggtaccagcagctcccagaaccgccccaagctcctcatctataggaatgatcagcgccctcgagggactacctgaccgtacttctcgtcggtctccgtaagtccgtggtccttcccgtcccgggtcccttccccgtcgggcctatccgaggttcgggccttcccggggtccggaggtacgtggacggcgttaggtaaattacgttaacgttggtgtaccgtagggtttaggggtagttcgacccgtaggtccgttgggtaggtcgggtccgggtacgggttcgggttcggggtcggggaacgggaccgaaaggtccgtacggtaacccggtcgtaacgggtccgacgacccgaaggtcccgtccgtcccccgttacggtccctaccttccgttacccgttcccctacccc

SEQ ID NO: 335546 - DNA, 612 bp, Homo sapiens
  misc_feature: GZ8MTXP02I10I4.25.23.C01.1.454.CMB.2.raw
  modified_base (242)..(242): a, c, t, g, unknown or other
  misc_feature (242)..(242): n is a, c, g, or t
  modified_base (559)..(559): a, c, t, g, unknown or other
  misc_feature (559)..(559): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctcgtggtgctccgtnagtgtctttatactggagctggactccgccaggtccggcgggagggctggagtggagtggacgtatagtatacgaatggaacttaaaccgaacctaacccgtaacccctcctacgaaaagtacgtcgaatcccaaccaatactacgacgtaccggaacaccgtcgaaaggggtactaccaggggttcttccgaggactaactccgtagtaacctttcgcgacgaccgtcggcccgacggacacggtaccctatacctaacgttgcgaccagacgtagttcgagcgtagtaccgttagttttagaattattaactttnttgtttgtcgttacttcgatgtaggacggacggaacggacgtacgtacgtacg

SEQ ID NO: 335547 - DNA, 764 bp, Homo sapiens
  misc_feature: GZ8MTXP02IZSKA.25.23.C01.1.454.CMB.2.raw
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagccaccctcagtgtctcggggacccccggnagagggtcctccatctnttgttctgggancagctccgagtcggaaattagttgtctactggtaccngcagctacccgaagaaccggccccaagcctacctacatctaagtaggaatgactcgaggccgcccctgaagggactacccgtgacccgtattcctcgtggcctaccggaagttccgtcgggtcccttcccgtaccgggtcccccttcccgtgggtaccccagttcccgaaggggtttcgggccccgttacccgggtaccggacggtagtacgggacggtcctaaggtaaacttacgtttacgtggtacgtacgttaggggttttagggacttcggacccgtaggttccgttagggtaacggttccgggtaccgggtaaccggggttcgggttaccgggggaccggggtaaacgggtaacccgtaaaggtcccggttaccggtacccggttacccggtaaacgggttacccgaccggaaccccggtttaacggcccggtaacccggtcccccccgttcgggtaccctacccgttccccggtttacccgtttaccccccggtcccccg

SEQ ID NO: 335548 - DNA, 601 bp, Homo sapiens
  misc_feature: GZ8MTXP02GZ7AJ.25.23.C01.1.454.CMB.2.raw
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagactgtacagtcacgaccggtgctcgatttagtacacgtgattagggattggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctctggtgctccgtnagtgtcttattactggagctggactccgcaggtccggccggggagggactggagtggattgggcgtaatatagtacgaatggaattaaccacctaaccaacccctcctacaaagacgtcgagtcccaccatancagcgacncgtcaggntcgagtntcctgctatcngtactntgcgactgcccgnggaccaccggtacctagtaactcgtgtccgacgtagacgtacgttcggaacttggcgtaacgtttagttttacgggaattaaaacttttattacgttcgtttacgttcgttacgtttacgttacgtaagttacggtacgggtacggtaacgggtacggtaccggtaccgtaccg

SEQ ID NO: 335549 - DNA, 741 bp, Homo sapiens
  misc_feature: GZ8MTXP02HLECT.25.23.C01.1.454.CMB.2.raw
  modified_base (174)..(174): a, c, t, g, unknown or other
  misc_feature (174)..(174): n is a, c, g, or t
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (507)..(507): a, c, t, g, unknown or other
  misc_feature (507)..(507): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcgagggtccgtgggcccagtctgtgctgactcacgccaccctnagtgtcgtcggggacccccggnaggaggtctccatctcttgttcgtaggancagctccgagtacggaaattagttntactacgtggaccagcagccacccgaagaaacccggccccaaagccctcctcacttctaagtaaggaatgactcgacgcccggccctaggaacgggtactacccgtgaccgtattcgtacgtggtcctaccggtaacgtcgtcgggtccctcccgtcccggcctttccccgtgggccctagtccgcggtcgggacccgttccgggaccgaggagtggacgtctaagtaacttagtagtgtcgtagtgggtttaggancgtaccgtagtccgttgggaacgttcggggtaccccggtaggggtttacggtccgggggaccgggtaacgggtaaaccccgaagtaccgggtcccggtacccggtttaacggtacggggtaaccctaccgggtaaccccggaaccgggtttcccggcccccggtttccccccggtccgggtaacccgttacccctccccggttttaaccccccgtttacccccccgtacccccg

SEQ ID NO: 335550 - DNA, 700 bp, Homo sapiens
  misc_feature: GZ8MTXP02H0BNA.25.23.C01.1.454.CMB.2.raw
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (585)..(585): a, c, t, g, unknown or other
  misc_feature (585)..(585): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcgagggtcctgggcccagtctgtgctgactcacgccaccctnagtgtctcgggacccccgggnaggacggtctccatctnttgtcgngggancagcctccgagtcggtaaattagttgctacgnggtaccagcacgctacccagaaacccgccccaagcctcctcatctaagtaggaatgaactcgacggccggccctaggaagggacctaaaccgtacgaccgtacttcccgtacgtcggtcctacggaacgttccgttcgggtcccttccccggttcccgggcccccctttaccccgcgggaccctaagttccggaacgggttcccggggacccggttcccgggggtacccggaaggggagttacgggggacggtccgttaaggtaaactttagttaccgtaggtcgtacggtagggttttagactcgaaccgtgtcgtaggngggtcggtacggtcggtggtacgggcgggaacggacacggtcctacggacccgttacggacggaaccgcgacccggaacggttccccgcccggtcccccgtacggtacctcccgg

SEQ ID NO: 335551 - DNA, 767 bp, Homo sapiens
  misc_feature: GZ8MTXP02IVBAI.25.23.C01.1.454.CMB.2.raw
  modified_base (244)..(244): a, c, t, g, unknown or other
  misc_feature (244)..(244): n is a, c, g, or t
tcagactgtacagtcacgaccggtgctcgatttagtacacgtgattagggattgggggggaaatactttctgagactcatgggcctcctgcacaagaacatgaaacacctgtggttcttcctcctcctggtggctactcccagatgggtcctgtcccagatgcacctgcaggagtcgggcccaggactggtgaagccttcggagaccctgtccctcacctgcagtgtctcgtggtggctccgtnagtgtactttattacgtggagtcgtggactcccgaccgaggtcccggccggggagggtactgggaggtggtagttggggacttaataagtaacgtaacggaaagttacggtaaactttaaaaccccaacccttaaaccctaaaccccccgttcctaacgaaacgtacgttaccgaacgtacccccaacctaattacgccaacggccggaacctaccggtacccggaagggtaacttaccgtagggtttcgtttacccgtaggtctaaacgttccgttacgtacctttccgtgaccgtaccgtcggacccgacggacccgaccggtacctaacgttacctacgttcgacgaccgaaggtaacgtacgttccgggtaacgtcggtaccggttaacgtttaacgtttaccgggaaacttaaattttacgttaatttcgtttacggtttacgtttaccgtttacgacgttaagggtacgggtaaccgggtaaccggtaacgggtacccggtaccggtacccgtaccg

SEQ ID NO: 335552 - DNA, 688 bp, Homo sapiens
  misc_feature: GZ8MTXP02FMST1.25.23.C01.1.454.CMB.2.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (350)..(350): a, c, t, g, unknown or other
  misc_feature (350)..(350): n is a, c, g, or t
tcagactgtacagtcacgaccggtgctcgatttagtacacgtgattagggattggggagagaagacaggattcaggacaatctccagcatggccggcctccctctcctcctcaccctcctcactcactgtgcagggtcctgggcccagtctgtgctgactcagcccaccctcagtgtccgtcgggacccccgggnaggagggtcctccatctcttgttcgtgggagcagctccggacgtacggaaattaagttntctacgtggaccagcagcctacccgaagaaacccggccccaagcctacctacatactagtaggaatgactcgacgccgcctagaggtactacccgngaccgtattccgtgtcggtacctaccggtaagtccgtcggtcccttcccggtccggtccccttccccgtggcccctaagtcccgaggttccggggccgtaccccggggttacgggaggtacgtgggaacggtctaagtaaattacgttacgtgtagtacgtaggtttgggaactcggactagtcgtaggtacggtaccggtcggtacggtcgggttccgggacgggtaacgggaaccaggtcgtaccggtaccgtacgttacggacgaccggacccgtaacgggcctaacccgccccgttcggtaccctaccgttcccttcccgtaccccgtcccccg

SEQ ID NO: 335553 - DNA, 660 bp, Homo sapiens
  misc_feature: GZ8MTXP02H2B36.25.23.C01.1.454.CMB.2.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgacctcagcccaccctcagtgtcgtcgggaccccccgggnaggacgggtcctccattcctctttgttcnggggactcagctccgacgtacggtaaattagtttagtctacgtggtaccagcagcctaccgacgaaacccggcccccaagcctcctactactacctagtaacggaatgatcgaagcccggtaccctgaggactccgtcgaccgtattcccgtcgtgtcctacgtaagtccgtcggcccttccgccgtcccgttcccgtcggcctagtcccgagttcggcccgttcccggcggagtagtcgaggtcgtaaggtaacttattacgtgtagtcgtagggtttgggcttcggcccgtagtgtcgtaggtcgggtcgtcgggtcggttcgggaacgggcgggtaccaacgggttccacgggtacccgtcggttacgaccgaacggacccggttaacggaccgttcccgaccccggttacggtacccttccg

SEQ ID NO: 335554 - DNA, 639 bp, Homo sapiens
  misc_feature: GZ8MTXP02HE8AE.25.23.C01.1.454.CMB.2.raw
  modified_base (304)..(304): a, c, t, g, unknown or other
  misc_feature (304)..(304): n is a, c, g, or t
  modified_base (358)..(358): a, c, t, g, unknown or other
  misc_feature (358)..(358): n is a, c, g, or t
tcagactgtacagtcacgaccggtgctcgatttagtacacgtgattagggattggggagctgtggtagagaagacaggattcaggacaatctccagcatggccggcctccctctcctcctcaccctcctcactcactgtgcagggtcctgggcccagtctgtgctgactcagccaccctcagtgtctgggacccccggcaggagggtctccatctcttgttcgtgggagcagcctccgacgtcggaaattaagttgtctactggtaccagcagcctccaagaaacccgcccccaagtccacctnatctataaggaatgatcagcgccctgaggtactaccgtgaccgtatcccctcgngtacgtacgacgtcgtcggcctccgtacgtccctccgtccggaccagtccagttcggcccgttccggaccggaggagtcgacggctaagaacttagtacctggtcgtagttacggttagggacgtaccgtacgtacggtacgttggtacgggttggtcccgggttaacgggttcgggttaaccgggacggggaacgggtaccgaaacggcggttaaccggaccgtaccgttacggtacgaaccgaccgaacggtctcccggccccctcggtccctacccgg

SEQ ID NO: 335555 - DNA, 529 bp, Homo sapiens
  misc_feature: GZ8MTXP01BGZ0W.51.66.F11.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnagagggtcaccatctcttgttctggaagcagctccaacatcggaagtaatgctgtaaacnggtacagcagctcccaggaaccggcccccaaatcctcatctacagtagtatcagcggccctcaggggtccctgaccccgattctctggctccaagtctggccacctcacgcctccctcggccatcagtcgggctccagtctgaggatgaggtcttattagttactgtgcagcagtgggatgacagcctgaagtgctcgagtggtggttacgttcgggcgggtaacgggacccgaaggtccgtcggacccgtccgttaacgggtcccg

SEQ ID NO: 335556 - DNA, 688 bp, Homo sapiens
  misc_feature: GZ8MTXP01D9FQX.51.66.F11.1.454.CMB.2.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (384)..(384): a, c, t, g, unknown or other
  misc_feature (384)..(384): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagcccaccctcagcgtctcgggacccccggnagggcggtccactatctcgttgttcgaggancacgtcctaccaacagtacggaaataatcgctaagtaaactcggacagcagcctacccgaaggaacccgaccccaaactcctacactctaacaagttaagtaactcgacggcccggtccctacggtaccggggtccctacgaacccccgtnttcctcgtcggccctaaaccgaacgtcgtcgaccctaccctcaccgtccctcccgtcgcctatccgagggtcggtcctaccgtaagttccgtagggaacggtatagggacggttacttttaaagtttactttaacgttggtcgacgaacggtacgtaggtagggtatacggacgtcgtccgtaggtaacgttcgttacgttagttaggttcgggttaacgggtttacgggttccgggggacggggtaaacggtaaccgtaacgttccggtaccggttaccccggttaacggttaacggtaaccg

SEQ ID NO: 335557 - DNA, 612 bp, Homo sapiens
  misc_feature: GZ8MTXP01C0OKK.51.66.F11.1.454.CMB.2.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcggggacccccggnagaggtcaccatctcttgttctggaagcagcctccaaacatacgggaaagtaatgctagtaaactggtaccagcacgcctacccgacggaaccgcccccaaactcctacatctaacagtataatcagccgcctcgacggggtcctgaccccgtattcncgtcggcctaccaagtccgtgccacctcacgcccttccgngcctatcgaggtcggcctacgagttcgtgaggtatggtagtactttaagtttacttacgtgtcgacgagcgtaaggtcgggaattcggaacgtacggtcccgttaggcgttcgccgttagaggtttgggtacgggtttaaccggttcgggggaccgggtaacgggtaaccctaaggtcccgtacggttacccgttccggttcggtaacccg

SEQ ID NO: 335558 - DNA, 517 bp, Homo sapiens
  misc_feature: GZ8MTXP01EKA0O.51.66.F11.1.454.CMB.2.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgttctggaagcagctccaacatcggaagtaatgctgtaaactggtaccagcagctcccaggaaccgcccccaaactcctcatctacagtagtaatcagcgcctcgacggggtccctgaccccgattctctgcctaccaagtctgcacctcacgcctcctgccatcagtggctccagtctgagntgagtcttagttattactgtgctagcagtggggatgacagcctgaagtgctcagtgttgggttagttcgggcgggaaggacccgaagccgtggacccgtcgttaagggtaaccg

SEQ ID NO: 335559 - DNA, 669 bp, Homo sapiens
  misc_feature: GZ8MTXP01CLYO1.51.66.F11.1.454.CMB.2.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcggacccccgggnagaggtcacatctcttgtctgancanctcaanatacgaatangntagtaacngacancacgcaccgacgaaccgaccccaaactcctacatacgtaacaagtagtaactacgacggccgacccgtacgaccggggtccctacggtaacccccgtacttcgtcgtcggtaccctaaccgaaacgtcctacggaccctaacccgtccacgtcccctcccgtagaccctacgtaccgacggtcggaccttaccgtagttcgtaggaacggtacgtacggtaacggttacttttaaagtttaacgtttacgttggttacgacgtacgtacgtacgtaggtaacgtacgtaacgacgtaccgtacggtaacggtcgttcgtacgttacgttacggttagggttacggttcgggttacggggtaacgggaaccggtaacgtacgtacggttacccgtaaccgttaacggtaacg

SEQ ID NO: 335560 - DNA, 603 bp, Homo sapiens
  misc_feature: GZ8MTXP01B1O8R.51.66.F11.1.454.CMB.2.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (266)..(266): a, c, t, g, unknown or other
  misc_feature (266)..(266): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggacccccggnagaggtcaccatctnttgttctggaancagctaccaacatacggaagtatgactagtaaacnggaaccagcagcctacccgacggaaccccgcccccaaactccacatcaacagtagtaatcagccgcctcgacgggtcccngaccccgtnttctgtcgcctaacaagtctcgccacctcacgccctccgngccatcgaggtcggcctacgtagtcgtaggaggtatggtaacgttctttaagttacgttacgtaggtgaccgagccgtaaggtggggtaatcgtaaccgacgtccgttggaacggttcttcgtaacttggttacggttgggttacgttccggggacggggtaaacggaccgtaacggtcgtacggacccgtccgttaagggtaacccg

SEQ ID NO: 335561 - DNA, 716 bp, Homo sapiens
  misc_feature: GZ8MTXP01DOHHF.51.66.F11.1.454.CMB.2.raw
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (368)..(368): a, c, t, g, unknown or other
  misc_feature (368)..(368): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctnagcgtctcgggacccccggnagagggtcaccatctcttgttctggaancagctcaacatcggaagtaatgctagtaaactggtaccagcaagctacccgacggaaccgacccccaaactcctactactactaacaagtagtaactccgagccggcccttcgacgggggtccctacgaacccccgtnttcctcgtcggtcctacccgaaagttccgttcggacccaaccccttcgaccgtccccttaccccgggtcggaccctaagttcgacgggtcgggaccttcgaacgttcgtaggagggtagtaggtacggtaacttttaactttaggtttaacccgtttgggtacgaccgttacgacgtaaggttcggggaaattcggaaccgtaacggtcccggtttaggaagggtttcgcccttaacgttacgtttggggttacggtttacgggtttcggggacccggggtaacgggtaacccgaacgggttccgtacccgggttaacccgggtttccccgtttaagggaaccccggg

SEQ ID NO: 335562 - DNA, 656 bp, Homo sapiens
  misc_feature: GZ8MTXP01BL0C4.51.66.F11.1.454.CMB.2.raw
  modified_base (204)..(204): a, c, t, g, unknown or other
  misc_feature (204)..(204): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtctcggggacccccggnagagggtcaccatctcttgttctggaagcagctaccaacatacggaagtaatgctagtaaactggtaccagcagcctaccccgaggaacccgacccccaaactcctacatctaacagtagtaatcagccgccctcgacggggtccctgaccccgtattctcgtcggcctaaccaagtctcgggcctaccctcacgtccctcccgtggcccatcgaggtcgggcctcgacgtctagagggatggacggttactttatttaacgtttaacgtggtcgacgtagcgtaaggttggggtaaatcggaaacccgtaggtcccttagggtaacgttcggttaccttacgttaaggtttgggttacgggtttaacgggtttccgggggacgggtaacggggaaccctaaagggtccgtaccgggttaccccggttaaccgtttaacggggtaaccccgg

SEQ ID NO: 335563 - DNA, 502 bp, Homo sapiens
  misc_feature: GZ8MTXP01EA2S9.51.66.F11.1.454.CMB.2.raw
  modified_base (204)..(204): a, c, t, g, unknown or other
  misc_feature (204)..(204): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnagagggtcaccatctcttgttctggaagcagctccaaacatacggaagtaatgctagtaaactggtaccagcagctccccaggaaccgcccccaaactcctcatctacagtagtaatcagcgccctcgacggggtccctgaccccgattcnctggcctacaagtcngccacctcacgccctcctgcccatcgagtcggctccagtctgaggatgagtcttattagttactgtgcagcagtgggatgacagctgaagtnctngtgtgttgttcggngaaggcaagcncgcgtcgngtcg

SEQ ID NO: 335564 - DNA, 575 bp, Homo sapiens
  misc_feature: GZ8MTXP01AHXZ5.51.66.F11.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (460)..(460): a, c, t, g, unknown or other
  misc_feature (460)..(460): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgttctggaagcagctaccaacatcggaagtaatgctgtaaacnggtaccagcagctcccaggaaccgcccccaaatcctcatctacagtagtaatcagccggccctcgaggggtcccctgaccccgtattctcgtcggcctaacccaagtcctcgggcctaccgtcacgcccctcccgtggcctatcgaggtcgggcctccgagtcgtgacgtatggagtctttagttacttactgtgcagngtagtgggatgaaccgtcgtcgtgtgtcgttctcgttagttggttacggttacggttccggggacgggaacggaccgtaacggtccgtacggttacccggttcgttaacggtccg

SEQ ID NO: 335565 - DNA, 561 bp, Homo sapiens
  misc_feature: GZ8MTXP01ACBVD.51.66.F11.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgtctggaagcagctaccaanatcggaatatgctgtaaacnggtaccagcagctcccaaggaaccgcccccaaatcctacatctacagtacgtaatcagccggccctgacggggtccctgaccccgattctctcggctaccaagtctaggccactcacgtccctccgtcggcccagtccaggtcgggcctccgagtctggagatgacgtactttattagttactgtgctagcagtgggatgacaggtcctggaagtcgctcgaagttggtaacgggttgttccggggcggaacggggacctaaagggtcccttacgggacccgttcgttaaccgggtaacccg

SEQ ID NO: 335566 - DNA, 622 bp, Homo sapiens
  misc_feature: GZ8MTXP01DXUCE.51.66.F11.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggacccccggnagaggtcaccatctcttgttctggaancagctaccaacatacggaataatgctagtaaacnggtaccagcagcctacccgaacggaacccgaccccccaaactccctacactctaacagtagtaatcgagccggccctcgacggggtcccctgaccccgtattctcgtcggcctaacccgaagttcgtcgcctaaccctcacgtcccctcccgtggcccatcaggtcggcctccgagtcgtaggacgtagtgtaacggtactttaagtttacgttacgttggttcgaccgagcgtagtaggggtaatcggtacacgtccgttaggaagttcgaccttgttagttcggttgggttacggttcggggacggaacgggaacccaaggtccgtacggttacccgtcgttaacgggtaacccg

SEQ ID NO: 335567 - DNA, 746 bp, Homo sapiens
  misc_feature: GZ8MTXP01A4RC4.51.66.F11.1.454.CMB.2.raw
  modified_base (203)..(203): a, c, t, g, unknown or other
  misc_feature (203)..(203): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggnagaggtcacatctcttgttctggaagcagcctaccaaacagttacggaaagttaatgactagtaaaactggtaacccagccaacgcctaccccgaacgggaaaccccgccccccaaaatcccctacaatacctaacaagttaagtaactccgaacggcccggtcccctacggaccgggggtcccctacggaacccccgtatttccgtcgtcggcccttaacccgaaaggttcccgtacgggaccctaaccccgttccgaaccggtcccccttaccccgtcgggacccctagtccgagggtcgggtccctccgtaacggtcgtaggaacggtagttggaacggttacttttaagttacgtttacgtggttacgaccgtaagccgtaaggtggggtaaactcggtaaccgacggtccctgggtaacgttcggttaccttacgttaggttcgggttagggttaacggttccgggggaaccgggtaaacggggaccctaacgggtccgttaccgggttaaccccggttccgttaacggggtaacccg

SEQ ID NO: 335568 - DNA, 671 bp, Homo sapiens
  misc_feature: GZ8MTXP01D2LJF.51.66.F11.1.454.CMB.2.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtctcggggacccccggnagagggtcaccatctcttgttctggaancagctaccaacatacggaagttaatgctagtaaacgtggtaccagcaacgcctaccccgaacgggaacccggcccccaaaactcctacatcctaacgagtaagtaatcacgccggcctcgacgggtccccngaccccatttctcgtcggcctcccaagttcgnggaccctaccctcaccgtccctccgtcgaccctatcgagtcgggtactcgtaacggtctaggacggtatacgacggttattttacgtttactttaaccgttggttacgccgaagtccgtaagggttgggaaaccgttggaaaccgtcgtcccgtaggtaagtcgggttccttacgttggtttagggtcggtttaacgggttccggggaacggggtaacggggtaacccaacggtccgggttaccgaacccggttttccgttaacgggtaaccccgg

SEQ ID NO: 335569 - DNA, 698 bp, Homo sapiens
  misc_feature: GZ8MTXP01EGJXI.51.66.F11.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (491)..(491): a, c, t, g, unknown or other
  misc_feature (491)..(491): n is a, c, g, or t
tcagcgatcgtatacacgaccggtgctcgatttagtcacgcgagaaggggtcagcttcatctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggnagagggtcaccatctcttgttctggaancagctaccaacagtacgaagtaatgactagtaaacgtggtaccagcacgcctaccccgaacggaacccggaccccccaaactccctactactacctaacgtaagtaacgttaactccgaacggtccggccccgttacgaccggggtccctacgtacccccgtacttcgtcgtcggtcctaacccgaagttcgtcggccctaccctcaccgtccctcccgtcgaccctagtcgaggtcggcctccgtagttcgtggacgtntaggagttactttattacgttcgttaggtcgtaacgagtacgtaggtgggtacgtacgaccgtacggtccgtagggtaacgttcggttaccttacggttaggttgggttacgggtttacgggttcggggaaccgggggtaaccgggtaaccgtaacgggttccgtaacccgggttaccggtttaacccggttaacgggtaaccccgg

SEQ ID NO: 335570 - DNA, 700 bp, Homo sapiens
  misc_feature: GZ8MTXP01A4SEM.51.66.F11.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgtctggaancagctcaacatacggaatatgctagtaaactggtaccatcagcctacccaggaacccgcccccaaactcctacatcctanagtagtatcgacgccggccctcgacggggtccctagacccccgtatttctcgtcggcccttaacccgaagttccgtcgggaccctacccgtcaccgtccccctcccgtcgggacccacgttaccgacgggttcggggtccctacccggtaacggttccgtacgggaacgggtacgttagggtaacggtttaccttttaagtttaacggtttaccgttgggttacgaccgaggtaccgtagggttacggggaaagttcgaaaccgtacggtacccgttgggtaaccgttcggttacccttcgttaggttgggttaacgggttacggttccggggaccgggaacgggtaccgaacgtcccggtacggttaaccccggtcggttaaccggtcccg

SEQ ID NO: 335571 - DNA, 677 bp, Homo sapiens
  misc_feature: GZ8MTXP01ESWIR.51.66.F11.1.454.CMB.2.raw
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctccaccctcctcactcactgtgcagggtcctgggcccagtctgtgctgactcagcccaccctnagcgtcgtcggggaccccggnagaggtcaccatctcttgttctggaancagctacaacagtacggaataatgctagtaaacnggtacagcacgcctacccgaaggaaccccgaccccaaactccctacacttctaactaagtaatactccgaacggccggccctacgaccggggttcccctaggtacccccgtatttccgtcgtcggtccctaaccgtaagtcgtcggaccctacccttcgaccgtccccttcccgtacggccctaagtccgagggttcggccttaccgtagtcgtaggacggtatggtagttactttaagttaacgttcgtagggtcacgtagtcgtaggtgggtaaactcggtaaaccgtacgtcgtagggtaacgttcggttacgttacggttagggttgggttaacggggttacggttccgggggacgggaacgggtacctaacggtccggtacgttacccggtaacggttaacggccg

SEQ ID NO: 335572 - DNA, 598 bp, Homo sapiens
  misc_feature: GZ8MTXP01B2H3R.51.66.F11.1.454.CMB.2.raw
  modified_base (206)..(206): a, c, t, g, unknown or other
  misc_feature (206)..(206): n is a, c, g, or t
  modified_base (408)..(408): a, c, t, g, unknown or other
  misc_feature (408)..(408): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcacgcccaccctcagcgtcgtcggggacccccggnagagggtcaccatctcttgttctggaagcagctaccaacagtacggaagtaatgctagtaaactggtaccagcagcctacccgaacggaacccgacccccaaaactccctacatacctaacaagtaagtaactacacggccggccctacgacggggtccctacgtaccccgtacttctcgtcggacctaaccgaagttccgngacctaccctacgaccgtccctcccgtcggaccctatccgagtcgggcctcgtaacgtcgtagagatgaggtactttaagttattacgtgtcgcgagcgtagtggatcgacacgcgtgaagtcgacttgagtggtaggttcgttcgggacgggaagggaccaagtcgtgacccgttcgttaagtaacccg

SEQ ID NO: 335573 - DNA, 674 bp, Homo sapiens
  misc_feature: GZ8MTXP01EBHYZ.51.66.F11.1.454.CMB.2.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggaccccggnagaggtcacatctnttgtctggaagcagcctaccaacagtacggaataatgctagtaaactcggtaccagcagcctacccgaacggaaccccgacccccaaactcctacactactaacagtacgtaactcgacgccggcctaccgacggggtccctacgaccctacgttctcgtcgcctaaccaacgtcgtacggaccaccctccgacctccccgtcccgtacggtaccctaactcgacgggttcgggcccttacccgaagttccgttaggaaagggagttacggtaacggttacttttaagtttactttaacggtgtttacgaccgagtaccgtaaggtgggtaaactcggaacgacgtccgttgggaagttcggcctagttagtcgggtttaaggttacggttccgggaacggggtaacgggaccaacggtacccgtaggttaccccggttaacgttaacggtaaccccg

SEQ ID NO: 335574 - DNA, 761 bp, Homo sapiens
  misc_feature: GZ8MTXP01BAD9C.51.66.F11.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcacgcccaccctcagcgtcgtcggggacccccggnagaggtcacatctnttgtcnggancagctacaacagtacggaataatgctagtaaacnggtaccagcacgcctacccgacggaaccccgacccccaaactcctacactactaacagtactaactccgacggccgacccgtacgtacgggggtccctacggtacccccgtatttcctcgtacggtccctaaacccgtaaacgttcccgtacgggaccctaaccccgttccgaccgtccccccttcccgtacggtccctaacgtccggtacgggtccgggtaccttacccgtacggttccgtagggtaaggtacgtgggttaacggttactttttaaccgtttaattttaccggttaggttcgtaaccgaagtccgtaagggttacgggaaagttccggaaaccgtacgttccccggtaagttcggtcggttcttaaccggttgtttaggggttaacggggtttaccgggttccgggggaaaccgggggtaacgggaccccgtaaggggttcccggtaccggttacccccgggttaacgttaacccgggtaacccgg

SEQ ID NO: 335575 - DNA, 754 bp, Homo sapiens
  misc_feature: GZ8MTXP01E1840.51.66.F11.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (458)..(458): a, c, t, g, unknown or other
  misc_feature (458)..(458): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtcgtcgggacccccggnagaggtcaccatctcttgtctggacgnagctaccaacatcggaagtaatgctagtaaactcggtaaccagcacgcctaccccgaacggaaccccggaccccccaaactcccctacactctaccgtaagtacgtaactcgacgccggacccccttacgacgggggtcccctcggacccccgtactttcgtcgtcggacccttaacccgaacgtcctacggccctaccctcgacgtcccctcccgtcggaccctanaccggtcggttcggggcccttccgaacgttccgtagagggtacgtacggtaggttactttaactttaacgttacccgtggttccggacgtacggacccgtaaacggttgggggaaacttacccggtaaaccgttacgaccccgtttggggaaccggtttcgttaccgtccgttaaaggttcgggtttaaccgggttcgggtttcccgggggaacccgggggtaaccgggggaaacccctaaacgggtcccggttaccgggttaccccggttaacccgttaacgggtaacccccggg

SEQ ID NO: 335576 - DNA, 785 bp, Homo sapiens
  misc_feature: GZ8MTXP01BVNFC.51.66.F11.1.454.CMB.2.raw
  modified_base (208)..(208): a, c, t, g, unknown or other
  misc_feature (208)..(208): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgacctcacgcccaccctcacgcgtcgtccggggaccccggnaggacggtcaccattcctcttgttcgtaggagcagctaccaactagtacggaagttaatgtactacgtaaacgtcggtaccagacacgcctacccgaacggaaccccgaccccctaaacctcctacctaacttacctacgaagttactaacgtccgacggtcccggtacccttacggaccggggttccctacggtaccccgttactttccgtacgtccggtcccttaaacccgtaacgttccgtaccgggtaccctaccccgttaccgacccgtccccgttcccggacggtaccctaagtcccggtaacggggtccgggtacccttccggtaaacggtttccgtaagggtaaacggttcgtaacgggttaacgtttaccgttttaaagtttaccggggtttaccgttagggttaccgaacgtaccgggtattaagggtagggtacctcgaaacccggtcgtaccgttgtaacggtcgttaccgtttaggttaggttcggttacggggttaaccgttcgggggacggttaaggacccctaagggtccctcgggttacccgttccgttaacggtaaccg

SEQ ID NO: 335577 - DNA, 529 bp, Homo sapiens
  misc_feature: GZ8MTXP01E5SEN.51.66.F11.1.454.CMB.2.raw
  modified_base (204)..(204): a, c, t, g, unknown or other
  misc_feature (204)..(204): n is a, c, g, or t
  modified_base (345)..(345): a, c, t, g, unknown or other
  misc_feature (345)..(345): n is a, c, g, or t
  modified_base (444)..(444): a, c, t, g, unknown or other
  misc_feature (444)..(444): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcacgccaccctcagcgtctggggaccccccggnagagggtcaccatctcttgttctggaagcagctccaacatcggaataatgctagtaaactggtaccagcaagctaccccgaggaaccggccccccaaatccctacatcacagtagtaatcagccgccctgacggggtcccngaccccgtattctctggcctaccaagtctggcaccctcgacgccctaccctggcccagtcagtggcctccagtctgagatgagtcttattagtactgtncagtcagtggatgacagcctgaagtgctacagtggtgacgttcgggacggaaggaccaagctacgacccgtccgttaaggtcccg

SEQ ID NO: 335578 - DNA, 553 bp, Homo sapiens
  misc_feature: GZ8MTXP01EXUMK.51.66.F11.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagcccaccctcagcgtctcgggacccccggnagagggtcaccatctcttgttctggaancagctccaacatcggaagtaatgctagtaaactggtaccagcagcctacccgaaggaacccgaccccccaaactccctacatctacagtagtaatcagccggccctcgacggggtccctgaccccgtattctcgtcggcctaaccaagtcgtgccaccctcacgtccctcctgccatcagtcggctcagtctgagatgagtcttattattactgtgcagcgtagtgggatcgacacgccgtgaagtgctcgttagtggtggttagttcggggacgggaaggggacccaaggtccgtacggacccgttcgttaacggtaaccg

SEQ ID NO: 335579 - DNA, 689 bp, Homo sapiens
  misc_feature: GZ8MTXP01DHFM4.51.66.F11.1.454.CMB.2.raw
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
  modified_base (538)..(538): a, c, t, g, unknown or other
  misc_feature (538)..(538): n is a, c, g, or t
  modified_base (601)..(601): a, c, t, g, unknown or other
  misc_feature (601)..(601): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcacgcccaccctcagccgtcgtccggggacccccggnaggaggtccacctattccttctttcgttcgtaggaagcacgtcctaccaaacacgtaacggaagttaatgacgttagtaaacgnggtaaccagcaacgcctacccgaacggaaccccgacccctaaactcctacactactaactaagtagtaactcgacgccggtcctcggtaccgggtccacggtaccccctacttcgcgtcgcctaaccgacgttcgtcgacctaccctcgacccgtccctcccgtaggaccctataccgggtacggtcggcccttaccggagttcgtagggacgtagtagtaacgttactttaacttaggtttaacncggtacacgagtacgtaggtcggtaatccggtaacgtctaccggtgaacggttcgttcttagnggtttaggtacgggttacggttccggggaaacggtaacgggactccggttcgtacccgggttaccgtttaacccgaacggtaaccccg

SEQ ID NO: 335580 - DNA, 540 bp, Homo sapiens
  misc_feature: GZ8MTXP02H655S.51.66.F11.1.454.CMB.2.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagaggtcaccatctcttgttctggaagcagctaccaacatcggaaagtaatgctagtaaactggtaccagcagctcccgaaggaaccgccccaaactcctcatctaacagtaataatcagccgccctcgacggggtcccctggacccccgtattcctcgtcggcctaccgaagtcctgggccaacctcacgtccctccctggcccatcaggtcggcctccgagtcngagatgagcttaattattacgtgtncgagcagtgggatcgacgacgccgtagagtgctcgtatggtggtacgtcgggacggaaggaccaagcgtacgacccgtacgtaaggcc

SEQ ID NO: 335581 - DNA, 505 bp, Homo sapiens
  misc_feature: GZ8MTXP02G62CS.51.66.F11.1.454.CMB.2.raw
  modified_base (460)..(460): a, c, t, g, unknown or other
  misc_feature (460)..(460): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgcgcagggtcctgggcccagtctgtgctgactcagccaccctcagcgtctcgggacccccggcagagggtcaccatctcttgttctggaagcagctccaacatcggaagtaatgctgtaaactggtaccagcagctcccaggaccgccccaaatcctcatctacagtagtaatcagccgccctcgacggggtccctgaccccgtattctctgctccaagtctggcacctcacgccttccctggcccattccagtggctcccagtctgaggatgagtcttattattactgtgctagcagttgggatgacagcgtgagtgctnagtgtgtacgttcggacggaaggaccaagctagaccgtcgtaggc

SEQ ID NO: 335582 - DNA, 547 bp, Homo sapiens
  misc_feature: GZ8MTXP02G47UB.51.66.F11.1.454.CMB.2.raw
  modified_base (201)..(201): a, c, t, g, unknown or other
  misc_feature (201)..(201): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctggaagcagctccaacatcggaagtaatgctgtaaactggtaccagcagctcccaggaaccgcccccaaatcctcatctacagtagtaatcagcgccctgacggggtccctgaccccgattcctctggcctccaagtctggccacctcacgccctccctggcccatccagtcgggcctcccgagtcctgaggattgaggtacctttagttattacgtgtgcgtaagcgtagtggggattacgacagcctaggagtcgacctcgagttcggtggttacgttcgggacggaaggacccgaagcgtacgacccgtcgttaacggccg

SEQ ID NO: 335583 - DNA, 549 bp, Homo sapiens
  misc_feature: GZ8MTXP02H01MW.51.66.F11.1.454.CMB.2.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
  modified_base (447)..(447): a, c, t, g, unknown or other
  misc_feature (447)..(447): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgtctggaagcagctccaacatcggaagtaatgctgtaaactggtaccagcagctcccaggaaccgccccaaactcctcatctanagtagtaatcagccgccctacgacggggtcccctggaccccgatttccncgtggccttacccgaagttcctggccaccctcaccgtccctccctgcccatccagtcggctccagtctgaggatgagtctttattattactgtnctagcagtgggatgaactgcctgagtcgactctagtggttggtacgttcggggacggaacgggaacccaaggtccgtacggacccggttcgttaacggcccg

SEQ ID NO: 335584 - DNA, 535 bp, Homo sapiens
  misc_feature: GZ8MTXP02JAGM8.51.66.F11.1.454.CMB.2.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (409)..(410): a, c, t, g, unknown or other
  misc_feature (409)..(410): n is a, c, g, or t
  modified_base (469)..(469): a, c, t, g, unknown or other
  misc_feature (469)..(469): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctggaagcagctccaacatcggaagtaatgctagtaaactggtaccagcagcctcccgaggaaccgcccccaaactcctcatctacagtanaatcagcgccctgaggggtccctgaccccgattctctggctccaagtctggccacctcacgccctcctggccatccagtcggctccgagtctgagnngagtcttattatacgtgacgctagcagtcgggatacgacacgcccgtagtcgccgttanagtggttcggttagtccgggacgggtaacggaaccgagtcgtacgacccgtccgtaggtcaaccgg

SEQ ID NO: 335585 - DNA, 596 bp, Homo sapiens
  misc_feature: GZ8MTXP02I9ZD8.51.66.F11.1.454.CMB.2.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnaggagggtcaccatctcttgttctggaancagctccaacatcggaagtaatgctagtaaactggtaccagcagcctcccgaggaacccgcccccaaactcctacatctacagtagtaatcacgccggccctcgacggggtccctagacccccgtattcctcgtcggcctaccgtaagtccgtcggcctaccctccgacgtcccctcccncggcccatcgagtcgggcctccgagtcnggaggtatggagtactttatttattacgtgtacgcgaagcagtggggatcggaactacggcctaggtacgtcgcttacgagttggttacgggttacgtccggggacgggaagggtaacccaaggtcccgtacggaccccggttacgtacggtaccg

SEQ ID NO: 335586 - DNA, 517 bp, Homo sapiens
  misc_feature: GZ8MTXP02GET28.51.66.F11.1.454.CMB.2.raw
  modified_base (201)..(201): a, c, t, g, unknown or other
  misc_feature (201)..(201): n is a, c, g, or t
  modified_base (470)..(470): a, c, t, g, unknown or other
  misc_feature (470)..(470): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatctcttgttctggaagcagctccaacatcggaagtaatgctagtaaactggtaccagcagcctaccccaggaaccgcccccaaactcctcatctacagtagtaatcagccgccctcgacggggtccctgaccccgtattcctctcggcctaccaagtcctcggccaccgtcacgtccctcccgtgccatcagtcggctcagtctgagctgagtctttattattactgtgcagcagtgggatgacagctgacgtgctnagtgtgtacgtcggacggaaggacaagctcgaccgtcgtacgtaccg

SEQ ID NO: 335587 - DNA, 602 bp, Homo sapiens
  misc_feature: GZ8MTXP02GRIA7.51.66.F11.1.454.CMB.2.raw
  modified_base (201)..(201): a, c, t, g, unknown or other
  misc_feature (201)..(201): n is a, c, g, or t
  modified_base (361)..(361): a, c, t, g, unknown or other
  misc_feature (361)..(361): n is a, c, g, or t
  modified_base (419)..(419): a, c, t, g, unknown or other
  misc_feature (419)..(419): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagaggtcaccatctcttgttctggaagcagctaccaaacatcggaaagtaatgctagtaaactggtaccagcagcctacccgacggaacccggcccccaaactcctcactcctacagtaagtaatcgacggccgccctcgacggggtccctgaccccgtnttcctcgtcggcctaccgaagtcgtcggcctaccctcacgtcccctcccgtcggcccntccgtaggtcgggcctcccgtagtccgtggacggtatggaggttactttaattactttacgtgtcgtacgaaggtccgaggttagggagttacgacgacgtccgtaggtacgtcgtacgttcgtaagtcggttaggttacgtcggggacggaacggtaccagtcgtacgaccgtcgtacgtcg

SEQ ID NO: 335588 - DNA, 515 bp, Homo sapiens
  misc_feature: GZ8MTXP02H40R9.51.66.F11.1.454.CMB.2.raw
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
  modified_base (452)..(452): a, c, t, g, unknown or other
  misc_feature (452)..(452): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggcagagggtcaccatctcttgttctggaagcagctccaacatcggaagtatgctgtaaactggtaccagcagctcccaggaaccgccccaaactcctcatcctanagtagtaatcagcgccctcgaggggtccctgacccgattctctggctcaagtctgcacctnacgtccctcctgccancagtcggctcagtctgagatgagtcttattattactgtcgntagctagtgggatggacagcctgagtcgntctagtgttggtacgttcgggacggaacgggaccaaggccgtaggacccgttcgtaacggccg

SEQ ID NO: 335589 - DNA, 641 bp, Homo sapiens
  misc_feature: GZ8MTXP02HRYB2.51.66.F11.1.454.CMB.2.raw
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcggggacccccgggcagagggtcaccatctcttgttctggaagcagcctccaacatcggaagtaatgctagtaaactggtaccagcagctcccgaggaaccgcccccaaactcctcactactacagtagtaatcacgccggccctcgacggggtccctacggaccccgtattcctctgctacccaagtctggcacctcacgtccctccctcggcctatccgaggtcgggcctacccgagttccgtggacggattcggaggttactttagtttaatttacgttgttcgaccgagacgtaggtacgggggtaatggaacccaggtccctagggacgttcggccttacgtaaggttgggttacgggttacggtttccgggggacggggaaccgggggtaacccaaaggggtcccgttacggtacccccggttaccggttaacgggttaccccgg

SEQ ID NO: 335590 - DNA, 665 bp, Homo sapiens
  misc_feature: GZ8MTXP02JCVPH.51.66.F11.1.454.CMB.2.raw
  modified_base (202)..(202): a, c, t, g, unknown or other
  misc_feature (202)..(202): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggnagagggtcaccatctcttgttctggaagcagctccaacatcggaagtaatgctagtaaactggtaccagcagcctcccgaggaacccggcccccaaactcctacatctacagtagtaatcagcgccctcgacgggtccctgaccccgtattcctctggcctcgaagtccgtcggccaccctcacgtccctcccgtcggcccattcccgagtcggggccttcccgacgttccgtaggaacggatagggacggttacctttaagtttactttaaccgttgttacgaccgtaagtaccgtaaggtcgggggtaattacggaccgtaacggtcccgtggtaaggttcggtaaccttccgtaagtttcggggttaggggtttacgtttccgggggaccgggggaaacgggaaccccgtaaaagggtccgtaccggtaccccggtttacccggtaaggggtaaccccgg

SEQ ID NO: 335591 - DNA, 560 bp, Homo sapiens
  misc_feature: GZ8MTXP02JBW5R.51.66.F11.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggaccccccggnagagggtcaccatctcttgttctggaancagctccaacatcggaataatgctagtaaactggtaccagcagctacccgaggaaccgcccccaaactcctacatctacagtagtaatcagccgccctcgaggggtcccngacccgattcnctggcctccaagtctggcctacctcacgcccctcccgtggcccatcgagtcgggcctcccgagtcctggagaagtgagtactttaatttacttacgtgtgcgaagtcgaagtgggatcgacgagccgtagacgtcgctcgagttggtgttaacggttccgggacggtaacgggaccaacggtcgtacgacccgttaccgtacggtaccg

SEQ ID NO: 335592 - DNA, 524 bp, Homo sapiens
  misc_feature: GZ8MTXP02JDWP8.51.66.F11.1.454.CMB.2.raw
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (446)..(449): a, c, t, g, unknown or other
  misc_feature (446)..(449): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggnagagggtcaccatccttcttgttctggaagcacgctccaacatcggaagtaatgctagtaaactggtaccagcagcctaccgaggaacccggacccccaaactcctacactctaaccagtagtaactcagcgaccccgtcgacggggtccctgaccccgtattcnctacggctaccagtctcgccactccactcctccgtgcccatnacggtcgctcgatcngagntgagtcttatatcngtnnnngngatgancgntgcgtgntcgtagtcggtagtacggtcggacggaacgacacggtcgacgtaccgtacgacgtcg

SEQ ID NO: 335593 - DNA, 603 bp, Homo sapiens
  misc_feature: GZ8MTXP02HKEMB.51.66.F11.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgttctggagcagctccaanatcggaagtaatgctagtaaactggtaccagcagcctacccgacggaaccgcccccaaactcctacatcgacagtaagtaactcagccggccctcgacggggtcccctagacccccgtattcgtcgtcggctaccgaagtctcggcaccctcaccgtccctcccgtcggacccatccgacggtcgggccttccgagttccgtaggacggtactaggacggttctttaaatttattaacgttgttacgcgtagactaggtacgggtattcgacgtacgcgtggtagtcgtctctagttgtcggtacggttcgggacggtaacgggaccgaaacgtccgtacggtacccgtaccgttacggacccg

SEQ ID NO: 335594 - DNA, 703 bp, Homo sapiens
  misc_feature: GZ8MTXP02JLG53.51.66.F11.1.454.CMB.2.raw
  modified_base (228)..(228): a, c, t, g, unknown or other
  misc_feature (228)..(228): n is a, c, g, or t
tcagcgatcgtatacacgaccggtgctcgatttagtcacgcgagaagggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatctcttgttctggaancagctccaacatcggaagtaatgctagtaaactggtaccagctagctacccgaggaccgccccaaatcctcatcgtacagttagaaactcgagcggacccctacgacggggtcccctaggaccccgtattccgtctcggaccttacccaaaggttcccgtagggccctaaacccccttcgtaccgacccggtaccccttaccgggtcccgaccgttaccaaacggttacgggaccggtccctaacgtaccgttcggtacgggtaacgtacggaggtaccggtttaacgtttaaagtttaaccttacgtttacgggtacgtacgtacgtaacgtacgggtacggtacgacgtaacgtaccgtacgtacggtacggtaccgttacgtacggttacggttacgggttaacgggttaccgggtacgggaacgggaaccggtaacggtaccggtaccggtaccggtaccggtacggtacg

SEQ ID NO: 335595 - DNA, 573 bp, Homo sapiens
  misc_feature: GZ8MTXP02I45YE.51.66.F11.1.454.CMB.2.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagaggtcaccatctcttgtctggaagcagctccaacatcggaagtaatgctagtaaactggtaccagcagcctacccgaggaacccgcccccaaactcctacatctacagtagtactcacgtccgccctacgacggggtccctagaccccgtattcctcgtcggctaccgaagtcctggccaccctnaccgtccctccctggccctatcgagtggctccagtcctggacgtatacgaggtactttagttacttactggtanacagactagtgggtatgaaccgngctagngtcgtctagtagtcggttacggttacggtccgggacgggaacggtaaccgaggtccgtacggtacccgtacggtacggtccg

SEQ ID NO: 335596 - DNA, 638 bp, Homo sapiens
  misc_feature: GZ8MTXP02GYHF2.51.66.F11.1.454.CMB.2.raw
  modified_base (183)..(183): a, c, t, g, unknown or other
  misc_feature (183)..(183): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggccccagtctgtgctgactcagccaccctnagcgtcgtcgggacccccggaggaggtcaccatctcttgtctggaancagcctaccaacatacggaatangctagtaaacnggtaccagcagcctacccgaaggaacccgacccccaaatccncatctanagtataatcaggccgcctagacggggtccctagaccccgtattccgctcggtcctaccgaagttccgcgaccaccttccgacgtccccctcctggaccagtccgagtcggtcctacccgtagtccgtaggaggtataggagttacctttaattagtttaccgttgcgacgagtctaagggtgggaactacgaccgaacggttccgaagggtacgttcggtacctttcgaaggtttccggggtaagggtttacgtccgggggaaacggaaaccggggaaaccctaacggccctaacgggtaccccgttaccggttaacggaccccg

SEQ ID NO: 335597 - DNA, 649 bp, Homo sapiens
  misc_feature: GZ8MTXP02H3D2K.51.66.F11.1.454.CMB.2.raw
  modified_base (204)..(204): a, c, t, g, unknown or other
  misc_feature (204)..(204): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccgggnagagggtcaccatctcttgttctggaagcagctacaaacagtacggaaagtaatgactagtaaacctggtaccagcacgcctaccccgaaggaaccccggaccccctaaactcctacactcctaacagtaagtaatccgacgccggccccgtcgacgggtccctagaccccgtattcctacgtggcctaccgaacgttcgtggcccacctcgaccgtccctacccgtcgcctatcgagtcgggcctcccgtagtccgtaggaagtacgtaggacggttacttttaacgttattacgtgtacgaccgagtctaggttgggtactagggaccagtcccgtgggtacgtcgtaccgtacgtaggttgggttacgggttaacggttcggggaccggggaacggtaaccgtaacggtccgtaccggtacccgttacggtacggtacccgg

SEQ ID NO: 335598 - DNA, 648 bp, Homo sapiens
  misc_feature: GZ8MTXP02GXUMW.51.66.F11.1.454.CMB.2.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (409)..(409): a, c, t, g, unknown or other
  misc_feature (409)..(409): n is a, c, g, or t
  modified_base (541)..(541): a, c, t, g, unknown or other
  misc_feature (541)..(541): n is a, c, g, or t
  modified_base (573)..(573): a, c, t, g, unknown or other
  misc_feature (573)..(573): n is a, c, g, or t
tcagcgatcgtatacacgaccggtgctcgatttagtcacgcgagaaggggtcagcttcagctgtgggtagagaagacaggactcaggacaatctccagcatggccagcttccctctcctcctcaccctcctcactcactgtgcgagggtcctgggcccagtctgtgctgactcagcccaccctcagccgtcgtccgggacccccggnacggaggtcacctntctcttgtctggaagcancctaccgaacagtacggaagtaatgtctagtaaacgtggtaccagcaacgtcccgtaccccgaagggaaacccccgacccccaaacctccgtactactacctaagtagtaactactcgaccgccggcccctaggacggggtcccttacggacccccgttattcctaccgnggtcccttaccgaaggttctaccggccctaacccgttcgccccgtcctaccccgtacgaccctacgtccggaggttccgggctacccgtagtacgtggacgtaagtcgtagtttactatttacgtgtgtagnacgagtagtggaatcggaactcgacgttaggngtctgcttaggttcggttacgggtacgacggggtacggaacggtaccacgcgtaccggtaccggtacgtaccgcg

SEQ ID NO: 335599 - DNA, 508 bp, Homo sapiens
  misc_feature: GZ8MTXP01D9KK1.2.49.E05.1.454.CMB.2.raw
  modified_base (338)..(338): a, c, t, g, unknown or other
  misc_feature (338)..(338): n is a, c, g, or t
  modified_base (487)..(487): a, c, t, g, unknown or other
  misc_feature (487)..(487): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgtctggaagcatgtccaacatcggaagtgataatgtatactggtaccagcagttcccaagagcggccccaagctcctcatctatagaaattatgaaccgtcctnaggggtccctgaaccgattctctggctccaagtctggcacctcagcctcctggccatcagtggctccggtccgagatggaggctgattatactgtgttggatgggacagcaagcttgagttgcttattgttcttcggaactgggaaccnggtcaccgtccgttaaggtcc

SEQ ID NO: 335600 - DNA, 516 bp, Homo sapiens
  misc_feature: GZ8MTXP01BTD99.2.49.E05.1.454.CMB.2.raw
  modified_base (364)..(364): a, c, t, g, unknown or other
  misc_feature (364)..(364): n is a, c, g, or t
tcagacgctcgacacacgaccggtgctcgatttagagcgactagcaacacacaaagggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaaccggtcctgacgggggtccctgaacccgattcnctggctccaagtctggcacctcacgcctcctggccatcagtcgggctccggtcgagatgggaggctgattattactgttgttggatgggacagcaagcttgagttgcttattgttcttcgggaatgggaaccacggtcacccgtcgttggtc

SEQ ID NO: 335601 - DNA, 569 bp, Homo sapiens
  misc_feature: GZ8MTXP01EU8BL.2.49.E05.1.454.CMB.2.raw
  modified_base (482)..(482): a, c, t, g, unknown or other
  misc_feature (482)..(482): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtaccaacatcggaagtgataatgtatactggtaccagcagtcccaagacgccggacccccaagctcctcatctatagaaattatagaacccggtcctacgacgggggtccctgaaccgtattctctcggctccaagtctggccacctcacgccctcccgtggccctagtcaggtcgggccttcccgggtcgagggactggggaggtctggtatttagttacgtgttgttggngtggggacaggcaagtccttgagttgctttagttgttcgttacggaacttggggaaccctacgggtccacccgtccgttaaggtccg

SEQ ID NO: 335602 - DNA, 509 bp, Homo sapiens
  misc_feature: GZ8MTXP01DUC0V.2.49.E05.1.454.CMB.2.raw
  modified_base (216)..(216): a, c, t, g, unknown or other
  misc_feature (216)..(216): n is a, c, g, or t
  modified_base (454)..(454): a, c, t, g, unknown or other
  misc_feature (454)..(454): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagagggtcaccatctcttgttctggaagcatgtccaacatcggaagtgataatgtatactggtaccagcagttcccaagagccggcccccaagctcctcatctatagaaattatgaaccgtcctcaggggtccctgaacccgattctctggcctccaagtctggcacctcagcctcctggccatcagtgggctccggtccgagatggaggctgattatactgtgttggatgggacagnaagccttgattgcttattgttcttggaactgggccaggtcaccgttccaaggtcc

SEQ ID NO: 335603 - DNA, 527 bp, Homo sapiens
  misc_feature: GZ8MTXP01CQI76.2.49.E05.1.454.CMB.2.raw
  modified_base (330)..(330): a, c, t, g, unknown or other
  misc_feature (330)..(330): n is a, c, g, or t
  modified_base (474)..(474): a, c, t, g, unknown or other
  misc_feature (474)..(474): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtacccccgggcaggagggtcaccatctcttgttctggaagcatgtccaacatcggaagtgataatgtatactggtaccagcagtcccaagagcgccccaagcctcctcatctatagaaattngaacccggtcctacgacggggtccctgaacccgtattctctggctccaagtctgccacctcacgcctcctggcccatcagtcgggctccggtcgaggactgggaggtctgattattactgtgttaggatgggacagcaagtccngagttgcttattgttcttcggaactgggccacggtcaccgtccgttaaggtcc

SEQ ID NO: 335604 - DNA, 526 bp, Homo sapiens
  misc_feature: GZ8MTXP01APQK2.2.49.E05.1.454.CMB.2.raw
  modified_base (216)..(216): a, c, t, g, unknown or other
  misc_feature (216)..(216): n is a, c, g, or t
  modified_base (339)..(339): a, c, t, g, unknown or other
  misc_feature (339)..(339): n is a, c, g, or t
  modified_base (458)..(458): a, c, t, g, unknown or other
  misc_feature (458)..(458): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagagggtcaccatctcttgttctggaagcatgtccaacatcggaagtgataatgtatactggtaccagcagttcccaagagccggccccaagctcctcatctatagaaattatgaaccgtccncgacggggtccctgaacccgattctctggctccaagtctggcacctcacgccctcctggcccatcagtcgggcctccggtccgagatggggaggctgattatctgtgttggatgggacngcaagccttggagttgcttagttcgttcttcggaactgggaaccacggtccaccgtccgttaaggtcc

SEQ ID NO: 335605 - DNA, 513 bp, Homo sapiens
  misc_feature: GZ8MTXP01ARZYP.2.49.E05.1.454.CMB.2.raw
  modified_base (215)..(215): a, c, t, g, unknown or other
  misc_feature (215)..(215): n is a, c, g, or t
tcagacgctcgacacacgaccggtgctcgatttagagcgactagcaacacacaaagggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagagggtcaccatctcttgtctggaagcatgtccaacatcggaagtgataatgtatactggtaccagcagttcccaagagcggcccccaagctcctcatctatagaaattatgaaccggtcctcaggggtcccctgaaccgattctctggctcaagtctggcacctcagcctcctggccatcagtcgggctccggtccgaggatggaggctgattattactgtgttggatgggacagcaagccttgagttgcttattgttcttcggaactgggaaccacgggtcaccgtcttaaggtc

SEQ ID NO: 335606 - DNA, 578 bp, Homo sapiens
  misc_feature: GZ8MTXP01A0MW2.2.49.E05.1.454.CMB.2.raw
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagcagttcccaagacgccggcccccaagcctcctcatctatagaaattatagaacccgttcctcgacgggggtcccctgaacccgatttcctctgggcctccaagtctggccaccctcacgccctcccgtcggccctatccgaggtcggggcctccgggtccgaggtactgggaggctgatttattacgtgtgttaggngtgggacagcgaagtccgttgagttgtactttancggttcttcgggaacttcggggaacccacggggttccacccggttccgttaaggtaacccg

SEQ ID NO: 335607 - DNA, 679 bp, Homo sapiens
  misc_feature: GZ8MTXP01BGI0C.2.49.E05.1.454.CMB.2.raw
  modified_base (198)..(198): a, c, t, g, unknown or other
  misc_feature (198)..(198): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggagaggtcaccatctcttgtctggaagcatgtccaacagtcggaagtgaataatgtatactggtaccagcagttcccaagacgccggacccccaagcctcctacaatctaataagaaattatacggaaacccggtccctacgacgggggtcccctggaaacccgtattccgtcgtcgggcctacccaaagttcgtggccctacccttcacgtcccctcccgtcggaccctagttccgagggttcgggccctcccgggtccgaagggtacgtggggaacgggtcttagtaatttaacgttactgggttaggtttagggagtcgggggtaacaacggccgtaacggtcccgttagggtacgttggtacctttaagttcgggttccgtttaaccggggtaaacgttccggggaaacccgtaacccggggttcccttaaaccccggttccgttaaacggggtccccg

SEQ ID NO: 335608 - DNA, 545 bp, Homo sapiens
  misc_feature: GZ8MTXP01DGIHE.2.49.E05.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (468)..(468): a, c, t, g, unknown or other
  misc_feature (468)..(468): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcaccatctcttgttctggaancatgtccaacatcggaagngataatgtatactggtaccagcagtcccaagacgcggcccccaagcctcctcatctatagaaattatagaaccggtcctacgacggggtccctgaaccgtattctctggctaccaagtctggccacctcacgccctcctggcccatcgagtcgggctccggtcgagatgggagtctagtattatacgtgtgttggatgggacngcaagtcttgtagttgtcttagttcgttcgttacggaacgtgggaaccctacgggtccaccgtccgttaaggaaccg

SEQ ID NO: 335609 - DNA, 550 bp, Homo sapiens
  misc_feature: GZ8MTXP01DCI8Q.2.49.E05.1.454.CMB.2.raw
  modified_base (217)..(217): a, c, t, g, unknown or other
  misc_feature (217)..(217): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgcctcggtacccccggnagaggtcaccatctcttgttctggaagcatgtccaacatcggaagtgataatgtatactggtaccagcagttcccaagagccgcccccaagctcctcatctatagaaattatgaaaccggtcctacgaggggtcccctgaacccgattctctcggctccaagtctggccacctcacgccctccctggcccatcaggttcgggccgttaccggtccgaggactgggaggtctgatttattacgtgtgttaggagtgggacagcaagcttgagttgctttattcgttctttcgggaattcgggaacctacggtccaccgttccgaaggtaacccg

SEQ ID NO: 335610 - DNA, 612 bp, Homo sapiens
  misc_feature: GZ8MTXP01DPJHA.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtaccaacatacggaagtgataatgtaatactggtaccagcacgttcccaagacgcccggaccccaagcctcctcatctatagtaaattatagaacccgtcctacgacggggtccctggaacccgtattctcgtcggcctaccgaagtctggccaccctcacgcccctcccgtggccctatcgtaggtcgggcctccgggtccgaggactggggagtctgtatttattacgtggttggttaggagtggggacaggcgaagtccgttaggtagttcgtacgtttaagttcggttccgtttacggggtaaccgtcggggtaaccccgtacggggttccaccccggttccgttaacgggtaacccg

SEQ ID NO: 335611 - DNA, 530 bp, Homo sapiens
  misc_feature: GZ8MTXP01AOIRJ.2.49.E05.1.454.CMB.2.raw
  modified_base (218)..(218): a, c, t, g, unknown or other
  misc_feature (218)..(218): n is a, c, g, or t
  modified_base (332)..(332): a, c, t, g, unknown or other
  misc_feature (332)..(332): n is a, c, g, or t
  modified_base (505)..(505): a, c, t, g, unknown or other
  misc_feature (505)..(505): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgtctggaagcatgtccaacatcggaagtgataatgtatactggtaccagcagttcccaagagccggcccccaagcctcctcatctatagaaattangaaccgtctcgaggggtccctgaaccgattctctggctccaagtctggccacctcacgccctcctggccatcgaggtcgggctccggtcgagatgggaggctgattattacgtgtgttggatggggactgcaagcttgagttgtcttagttgttcttcggaacgtgggaaccncgggtcaccgtccgttaagggtccg

SEQ ID NO: 335612 - DNA, 610 bp, Homo sapiens
  misc_feature: GZ8MTXP01A64DC.2.49.E05.1.454.CMB.2.raw
  modified_base (215)..(215): a, c, t, g, unknown or other
  misc_feature (215)..(215): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccggnagaggtcaccatctcttgttctggaagcatgtccaacatcggaagtgaataatgtatactggtaccagcagtccccaagagccggacccccaagcctcctcatctatagaaattatagaaaccgtcctcgaacggggtcccctgaaacccgtatttcctcgtcgggcctacccaagtcctggcccaccctcacgccctcccgtggcccatcaggtcgggcctccgggtccgaggtatgggggagtcgtagaactttagttaaccgtggttgtttagggattgggggacaggccaaggcccttggtaagttgtacctttaagttggttccgtttacgggaaccgttcggggaacccgtaaccggggtccaacccggttccgttaacgggtaacccg

SEQ ID NO: 335613 - DNA, 561 bp, Homo sapiens
  misc_feature: GZ8MTXP01AFX4J.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggcagagggtcaccatctcttgttctggaagcatgtccaacatcggaagtgataatgtatactggtaccagcagttcccaagacgccggccccaagctcctcatctatagaaattatgaaccgtcctcgacgggggtccctggaacccgtattcgtctcggctaccaagtctggccacctcacgccctccctggccatccaggtcgggcctccggtccgagatgggagctgatttattactggtgttggagtggggacagcaagccgttggacgttgtctttattcgttcgttcggaacgttcggggaaccctacgggtcttacccggttccgttaacggggtcccg

SEQ ID NO: 335614 - DNA, 540 bp, Homo sapiens
  misc_feature: GZ8MTXP01A7TAW.2.49.E05.1.454.CMB.2.raw
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (488)..(488): a, c, t, g, unknown or other
  misc_feature (488)..(488): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagaggtcaccatctcttgtctggaagcatgtccaacatcggaagtgataatgtatactggtaccagcagttcccaagagccggcccccaagctcctcatctatagaaattangaaccggtcctgacggggtccctgaaccgtattctctggctcaagtctggcacctcacgccctcccgtggccagtcgagtcgggcctcccgggtccgaggactgggaggtctgtattattcgtgtgttggntgggacnggcaagtccttgagttgcttancgttcgttcgggaactcggggaaccacgggtcacccggtccgttaaggtccg

SEQ ID NO: 335615 - DNA, 515 bp, Homo sapiens
  misc_feature: GZ8MTXP01BBT6Q.2.49.E05.1.454.CMB.2.raw
  modified_base (423)..(423): a, c, t, g, unknown or other
  misc_feature (423)..(423): n is a, c, g, or t
tcagacgctcgacacacgaccggtgctcgatttagagcgactagcaacacacaaagggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgtctggaagcatgtccaacatcggaagtgataatgtatactggtaccagcagttcccaagagcggcccccaagctcctcatctatagaaattatgaacccggtcctcgagggggtcccctgaacccgattctctggctccaagtctggcacctcacgcctcctggccatcagtgggctccggtccgaggntgggaggctgattatactgtgttggatgggacagcaagcttgagttgcttattgttcttcggaactgggaaccacggtcaccgtcttggtcc

SEQ ID NO: 335616 - DNA, 558 bp, Homo sapiens
  misc_feature: GZ8MTXP01E0483.2.49.E05.1.454.CMB.2.raw
  modified_base (219)..(219): a, c, t, g, unknown or other
  misc_feature (219)..(219): n is a, c, g, or t
  modified_base (485)..(485): a, c, t, g, unknown or other
  misc_feature (485)..(485): n is a, c, g, or t
  modified_base (534)..(534): a, c, t, g, unknown or other
  misc_feature (534)..(534): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtccaacatacggaagtgataatgtatactggtaccagcagttcccaagacgcggcccccaagcctcctcatctataagaaattatacgaacccggtcctacgacgggggtcccctgaaacccgatttccgtcgtcggctaccaagtctggccacctcacgccctcccgtggcctatcgagtcgggcctccggtcgaggatgggaggctgtattattactgtgttggatgggacngcaagcgttgagttgtcttagttgttcgttacgggaactcgggaacccncggtccaccgtccgttaagggtcc

SEQ ID NO: 335617 - DNA, 755 bp, Homo sapiens
  misc_feature: GZ8MTXP01DHQ0L.2.49.E05.1.454.CMB.2.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagacggtcacntctcttgtcngancatgacanagtagagnatatntatacgtgtacagacacgtaccaagacgccgaccccacncctcctactactactaataagtaaattagtacgtaacccggtccgtacggtacggggtccctacggtaaacccgttacttccgtcgtcggtacctaccgtaacggtccgtacggaccctaccctaccgtaccgtccccgtcccgtccggtaccctacgtaccggtacgggttccggggtacccgttcccggggtacccgggtagggtacgttacgggggtacgggttacgttagttaaacgtttaacgtttaacgttgggttagggtttaggggtacggttacgggggtaaccgtacgggtaccgtaacggtccggttagggtacggttcgttaccgtttaacggttccggtttcccggtttaacccggggtaaacccggttacccgggggtaaccccgtacccggggttaccccgttaccccgggtttaacccggttaaccgggtaacccg

SEQ ID NO: 335618 - DNA, 555 bp, Homo sapiens
  misc_feature: GZ8MTXP01DEAD2.2.49.E05.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (438)..(438): a, c, t, g, unknown or other
  misc_feature (438)..(438): n is a, c, g, or t
  modified_base (479)..(479): a, c, t, g, unknown or other
  misc_feature (479)..(479): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttcnggaancatgtccaacatcggaagtgataatgtatactggtaccagcacgttcccaagacgccggacccccaagcctcctcatctatagaaattatcgaacccggtcctcgaggggtcccctgaacccgtattctctggcctccaagtctgggcacctcacgccctcctggcccatcgagtcgggctccggtcgagntgggacggtctgtattattacgtgttggttggagtgggacngcaagcttgtagttgtcttattgttcttacgggaactcgggaacctacgggtcttaccgtccgttaagggtaaccc

SEQ ID NO: 335619 - DNA, 769 bp, Homo sapiens
  misc_feature: GZ8MTXP01EW7NJ.2.49.E05.1.454.CMB.2.raw
  modified_base (342)..(342): a, c, t, g, unknown or other
  misc_feature (342)..(342): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagtccaccctcagccgtctcggtacccccggcaggagggtcaccatctcttgttctggaagcatgtaccaaacatcggaagtgaataatctaatactggtaccagcagttcccaagacgccggccccaagcctcctcatctaataagaaattanacgtaacccggtcctacgacggggtccctcggaaacccgtattccgtcgtcgggcccttacccaaaggttcctcgggaccctaacccttccacggtcccctccccgtcggaccctaagttccgaagggttccggggacccgttccccgggggttacccggaaaggggtacgttcggggggaacggggtacctttagggttaaacttttaaagttttaacccggttgggtttagggtttacgggggtaaacggttggggggtaacctaaagggtcccgaagggtccccgtttagggaaagggtttcggtaccttttaagttcgggtttcccggtttaaccgggggaaaccggtttacgggggtaacccccgtaacgggggtttaccccgttaaaccccgggtttcccggttaacggggttaaccccgg

SEQ ID NO: 335620 - DNA, 555 bp, Homo sapiens
  misc_feature: GZ8MTXP01A5VIN.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagcagttcccaagagccggcccccaagcctcctcatctatagaaattatgaacccggtcctcgagggggtcccctgaaccgattctctggcctccaagtctggccacctcacgccctccctggccatcagtcgggcctccgggtccgaggactggggaggtctgtatttattcgtggttggttggagtggggacagcaagccttggacgttgtcttagttgttcttcgggaactggggaacccacggtcacccggtccgttaagggtcccg

SEQ ID NO: 335621 - DNA, 555 bp, Homo sapiens
  misc_feature: GZ8MTXP01C6PZB.2.49.E05.1.454.CMB.2.raw
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggaggtccgggggaggcttagttcagccgtggggggtccctgagactctcctgtgcagcctctggattcaccttcagtcgctactggatgcactggttccgccaaagttcccgaggggaagggggctgggagtgggtctcgacgcattgatccatccgngggaatggattaacacgcgcctcgtgagggccatcacatctccaganacacgccaggacatctgatcgagaatgggaancagtctacgaggacggcgaacggctaacggtcttaggttttataactggacaacgaaggtcggacggttcggttcgggggataaccgtgaacttacgggtcgggggacctaaggggctaagg

SEQ ID NO: 335622 - DNA, 778 bp, Homo sapiens
  misc_feature: GZ8MTXP01A6FFD.2.49.E05.1.454.CMB.2.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtaccccggnagagggtcaccatctcttgttctggaagcatcgtaccaacagtacggaagtgaataatgtaatacgtggtaccagcacgttacccaagacgccggacccccaagcctcctcatctaataagtaaattagtacgaaccccggttcctacgacgggggttcccctacggaaacccgtatttccgtccgtcgggacccttacccgtaacggttccgtcgggtaccctaccccgttccgaaccgggtcccccctttcccccggtacgggacccctaaacggttcccggtaacgggggttccgggggtaccccgttccccgggggtaaccccgggtaaggggttaccgtacggggggtacggggttacctttagggttaaactttttaacgtttaaccggttgggtttacggtttaggggaagttacgggggaactacgggtacgaacgggtccgttagggtacgttcgttacgtttaacgttcgggtttccgtttaacggggtaaacgttccggggaacccgttaaccgggtccgttacccggttaaccgttaacgggtaacccg

SEQ ID NO: 335623 - DNA, 614 bp, Homo sapiens
  misc_feature: GZ8MTXP01C13U8.2.49.E05.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtaccccccgggnaggaggtcactatctcttgtcnggaancatcgtacaacagtacggaagnaataatgtatacgtgtacagctacgtaccaagacgccgaccccaagcctcctacatactaataagtaaattagtacggaacccgtcctacggtacgggtccctacgaaccgtattctcgtcgcctaccgaagtcgtcgcctacctcacgccctcccgtcgcctactcgacggtcgggccgttccgggtaccgaggagtggggaggtctagtaatttaacgttacgtggttaggttacggagtagggaacacggcgtaacggtccgttggtacgttcgtacttagttcgttcgttacggtaacgtacggtaaccgaccgtaccgttaccgtccgttaacgtaacg

SEQ ID NO: 335624 - DNA, 542 bp, Homo sapiens
  misc_feature: GZ8MTXP01EU1HX.2.49.E05.1.454.CMB.2.raw
  modified_base (197)..(197): a, c, t, g, unknown or other
  misc_feature (197)..(197): n is a, c, g, or t
  modified_base (245)..(245): a, c, t, g, unknown or other
  misc_feature (245)..(245): n is a, c, g, or t
  modified_base (335)..(335): a, c, t, g, unknown or other
  misc_feature (335)..(335): n is a, c, g, or t
  modified_base (472)..(472): a, c, t, g, unknown or other
  misc_feature (472)..(472): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctggtacccccgggcagagggtcaccatctcttgttctggaancatgtaccaacatcggaagtgataatgtatactggtaccagcagttcccaagacgccggacccccaagcctcctcatctatagaaattangaacccggtcctacgaggggtccctgaacccgattctctgctccaagtctggcacctcacgccctcccgtggccatcaggtcgggctccggtcgaggatggggaggtctgtattattacgtgttgttggatgggacnggcaagcttgagttgcttagttcgttcttcgggaacttgggaaccacgggtcaccgtccgttaaggtccc

SEQ ID NO: 335625 - DNA, 549 bp, Homo sapiens
  misc_feature: GZ8MTXP01BY0H1.2.49.E05.1.454.CMB.2.raw
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
  modified_base (456)..(456): a, c, t, g, unknown or other
  misc_feature (456)..(456): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagaggtcaccatctcttgtctggaagcatgtccaacatcggaagtgataatgtatactggtaccagcagtcccaagngcgccccaagctctcatctatagaaattatgaaccggtcctcgacgggggtccctgaacccgattcnctggctccaagtctgcactcacgtcctcctgcctatcagtcgggcctccggtccgaggattggggaggtcgtgatttagttactggttgttggnttggggacagcaagtccttggtacgttgtcttagttgttcgtttacggaacgttgggaaccctacgggtccttacccgtccgttggtaacccg

SEQ ID NO: 335626 - DNA, 646 bp, Homo sapiens
  misc_feature: GZ8MTXP01BKXAU.2.49.E05.1.454.CMB.2.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
tcagacgctcgacacacgaccggtgctcgatttagagcgactagcaacacacaaaggggggggaagctcagcttcagctgtggtagagaagacaggattcaggacaatctccagcatggtcggcttccctctcctcctcaccctcctcactcactgtgcagggtcctgggcccagtctgtgctgactcagcccaccctnagcgtctcgggtacccccggagacggtcaccatctcttgttctggaancatcgtaccaacagtacggaagtgaataatgtatacgtggtaccagctacgtacccaaggacgcccgacccccaagcctcctacatactaataaagtaaattagtacggtaaaccccggttcctacggacgggggtcccctaggtaacccgttatttccgtcgtcgggacctaccgtaagttccgtcgggaccctaccctcaccgtccccttcccgtcggaccctagtccgtagggtccgggccgtcccgggtacgaggtacgtgggggaagtcgttagtatttagttacgttggtggttagggagtggggactcggctaacggccgttggtacgttgtcttagttcgttcgttacggaacgtcgggaacctcgggtccacccgttcgttaacggtccg

SEQ ID NO: 335627 - DNA, 589 bp, Homo sapiens
  misc_feature: GZ8MTXP01DEQ1F.2.49.E05.1.454.CMB.2.raw
  modified_base (220)..(220): a, c, t, g, unknown or other
  misc_feature (220)..(220): n is a, c, g, or t
  modified_base (346)..(346): a, c, t, g, unknown or other
  misc_feature (346)..(346): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctccaccctcctcactcactgtgcagggtcctgggcccagtctgtgctgactcagccaccctcagcgtctcggtacccccgggnaggaggtcaccatctcttgttctggaagcatcgtccaacagtcggaagtgaataatgtatacgtggtaccagcacgttacccaagacgcccggacccccaagcctcctcatctaatagtaaattanacgaacccgtcctcgacggggtccctgaaccgtattctcgtggcctaccaagtctcgccaccctcaccgccctcccgtggcccatcgaggtcgggccttccgggcgagatcggggaggtctgtattagttacgtgttggttaggagtggggacaggcaagccgttggacgttgtccttaattcggttcgttacgggaacgtcgggaacccgtacggtcccacccggttccgttcggtaacccg

SEQ ID NO: 335628 - DNA, 592 bp, Homo sapiens
  misc_feature: GZ8MTXP01DI5B4.2.49.E05.1.454.CMB.2.raw
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
  modified_base (583)..(583): a, c, t, g, unknown or other
  misc_feature (583)..(583): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagaggtcaccatctcttgttctggaagcatgtccaanatcggaagtgaataatgtatactggtacagcagtcccaagagccgccccaagctctnatactataagaaattagtagaacccggtcctacgacggggtccctaggaaccgtattcctcgttcggccttaccgaagtcgtcggacctacccgtcacgtcccctcccgtcggccctaagtccgaggttccgggccttcccgggtaccgaggtactggggaggtcttagtaatttacttagtgttgttggatgggacagcgaacgtcttggagttgtactttagttgttcgttacggaacgtcgggaaccacgggtccaccggttccgngggtaaccc

SEQ ID NO: 335629 - DNA, 635 bp, Homo sapiens
  misc_feature: GZ8MTXP01BCU3W.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnagaggtcaccatctcttgtctggaancatgtaccaacatcggaagtgataatgtatactggtacagcacgtccaagcgccggacccccaagcctcctacatactaataagtaaatttagtacggtaaacccggtcctacggtaacgggggtccctggaaacccgtatttccgtctcgggtccctaccaagttcgtcgggaccctacccttcacgtccctcccgtgggcccagtccgaggtcggggccttcccgggtacgagggtactggggagtctagtaactttagttacgtggttagtttgggagttcggggactacggcaacggtcgttggaggttcgtctttaagttcggtttcgttaccgggtaacggtcgggtaacccgacgggttccaccccggttcgttaacgggtccg

SEQ ID NO: 335630 - DNA, 579 bp, Homo sapiens
  misc_feature: GZ8MTXP01ENW44.2.49.E05.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtcgtcggtacccccgggnagaggtcaccatctcttgtctggaagcatgtccaanatcggaagngataatgtatacgtggtaccagcagtacccaagcgccggaccccaagcctcctcatctataagaaattangtaacccgtcctgacgggtccctgaaccgtnttcncgtcgctaccagtcnggccacctcacgtccctcccgtggaccagtcgaggtcggcctccggtcgaggtactgggggacgtcgtagtatttattacgtggttggttaggagtggggacaggcaagtccgttggagttgtcttagttcgttccgttacgggaacgttcgggaaccgtccggtacgttacccgttccgttaacggtaacccg

SEQ ID NO: 335631 - DNA, 703 bp, Homo sapiens
  misc_feature: GZ8MTXP01DL73M.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcgggtacccccggnaggaggtcaccatctcttgttctggaagcatcgtaccaacatcggaagtgataatgtatacgtggtaccagcagtcccaagacgccgaccccaagcctcctcatctaataagtaaattagtacggaacccggtccctacgtacggggtcccctagaactagtaacttcctcgtcggtcctaccgtaagtccgtcggtacccacccgttcaccggtccccttcccgtcgggacccctagttaccgtaacgggttccggggcccgttacccggggtaccggaagggtacggtgggtaacgggtccttagggttaactttagtttacgttgggtttagggtttaggaggttacggggacaaggaaccgtaacggttcccgttaggttacggttcgtacgtttacgttcggttaccgtttaaccggggtaaccggtccggggtaaccccgtacgggttcccgtaaccccggtttccggttaaccggg

SEQ ID NO: 335632 - DNA, 560 bp, Homo sapiens
  misc_feature: GZ8MTXP01DUMNC.2.49.E05.1.454.CMB.2.raw
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagaggtcaccatctcttgtctggaancatgtccaacatcggaagtgataatgtaatactggtaccagcagttcccaagagccggccccaagctcctcatctatagaaattatgaaccgtcctacgaggggtccctgaacccgattctctggctctaagtctggcaccgtcacgcctccgtggcccatccagtcgggctccggtccgaggactggggacggtcttagtatttagttacgtgttgttaggagtggggacnggnaagtccttggaagttgctttaagttcgttcgttacgggaacttcgggaaccctacgggtccgacccgtcgttaacggtcccg

SEQ ID NO: 335633 - DNA, 567 bp, Homo sapiens
  misc_feature: GZ8MTXP01DN2Y2.2.49.E05.1.454.CMB.2.raw
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagaggtcaccatctcttgttctggaagcatgtccaacatcggaagngataatgtatactggtaccagcagttcccaagagccgaccccaagctcctcatctatagaaattntacgaaccgtcctcgacggggtccctgaacccgtattctctcggctccaagtctaggccacctcacgtccctccctcggcccagtccaggtcgggcctcccgggtaccgaggacgtggggacggtcttagtactttaattacgtgttggttaggagtgggacagcaagccttggtacgttgtactttagttcgttcgttacggaacgtgggaaccacggtcaccgtccgttaagggtcc

SEQ ID NO: 335634 - DNA, 686 bp, Homo sapiens
  misc_feature: GZ8MTXP01EZCDV.2.49.E05.1.454.CMB.2.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtctcgggtacccccggnaggnggtcaccntctcttgtctggaancatcgtccaacagtacggaagtgataatgtatacgtggtaccagcacgtacccaagacgcccggacccccaagcctcctactatactaataacgtaaattacgtacgtaaaccccggtcctacggtacgggggtccctacggaacccgtattccgtcgtcggccttaccgaagttcgtacggcccaccctcaccggtcccctcccgtcggcctaacgtccgtagggtcgggtccgtcccgggtaccggaaggtacgttgggggaacggtcgttaggtatttagttacgttgggtttggttagggaagttcggggaaacctcggacgtaacggtcggttaggtacggttcgttacgtttagttcgggtttccgttaaccggggtaacggtaccgggtaacccgtacggtcccgttacccggttaaccgttaacggaaccg

SEQ ID NO: 335635 - DNA, 600 bp, Homo sapiens
  misc_feature: GZ8MTXP01BDW7Z.2.49.E05.1.454.CMB.2.raw
  modified_base (217)..(217): a, c, t, g, unknown or other
  misc_feature (217)..(217): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagaggtcaccatctcttgttctggaagcatgtccaacatcggaagtgataatgtatactggtaccagcagttcccaagacgccggcccccaagctcctcatctatagaaattatgaaccgtcctcgacggggtccctgaaccgtattctctggctccaagtctggccacctcacgtccctcccgtggcccatcgaggtcgggcctccgggtccgaggacgttcggggaggtccttaggtaatttaacgttaccgttggttggtttagggacgttgggggaaccagggccaacggtcccgttaggagttcgtactttaagttcggttcgttacggaacgtcgggaaccctacgggtccttacccggtccgttaacggtaacccg

SEQ ID NO: 335636 - DNA, 644 bp, Homo sapiens
  misc_feature: GZ8MTXP01D0ETL.2.49.E05.1.454.CMB.2.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
tcagacgctcgacacacgaccggtgctcgatttagagcgactagcaacacacaaaggggggggaagctcagcttcagctgtggtagagaagacaggattcaggacaatctccagcatggcccggcttccctctcctcctcacccctcctcactcactgtgcagggtcctgggcccagtctgtgctgactcagccaccctnagcgtctcggtaccccggnagaggtcaccatctcttgttctggaancatgtccaacatacggaagtgataatgtatactggtaccagcacgtcccaagacgccgaccccaagctcctacatctaataagtaaattagtacggtaaacccgtcctacgacgggggtcccctaggtaaacccgtatttcctcgtcgggtacccttaccgaacgttctacgggaccctacccttcaccgtcccctcccgtcggccctaacgtcgtacggttccgggccgttccccgggtaccggagggtacgtgggggacgggtcttaggtaatttacgttacgttgttggttaggtagtggggacagcgaagtccgttgagttgtcgttagttcgttccgttacggaacggtacgggcccgtaacggtcccttaccgttccgttaacggtaacccg

SEQ ID NO: 335637 - DNA, 771 bp, Homo sapiens
  misc_feature: GZ8MTXP01E2O07.2.49.E05.1.454.CMB.2.raw
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
tcagacgctcgacacacgaccggtgctcgatttagagcgactagcaacacacaaagggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccggnagaggtcaccatctcttgtctggancatgtccaacatcggaagngataatgtatactggtaccagcacgttcccaagacgccggcccccaagcctccctacactctaataagtaaaattagtacggaaaccccggttccctacggacgggggttcccctggtaaacccggtactttcctccgtcgggtccctaccgtaaacgttccgttacgggaccctaaccccttccgaaccgggtccccctttcccccggtaccggggcccctaaccgttccgtaaacggggtttcccgggggcccgttccccccgggggtttacccgggaacgggtaacggtttcgggggaaaggggttcccttacgggttaaatttttaacgtttaacccggtttgggttacgggtttttacggggaaggttacggggggtaaccctaagggcccgtaacgggtcccgttaggtaaggttcggtactttaacgttcggttccgttaccgggtaaccggtccggtaacccgtacccgggtaccttacccggtaaccgttaacggtaaccccgg

SEQ ID NO: 335638 - DNA, 622 bp, Homo sapiens
  misc_feature: GZ8MTXP01B5W2K.2.49.E05.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctnagcgtctcggtacccccgggaggaggtccaccatctnttgtcnggaancatgtccaacatacggaagtgaataatgtaatacgtggtaccagcacgttacccaagacgcccggacccccaagcctcctacatactataagaaattatacgaaccccggtcctacgacggggtccctgaacccgtattctctggcctaccaagtctggccaccctcacgccctccctcggcctatcgaggtcgggcctcccgggtcgaggtagtggggaggtctgtatttagttacgtggttaggttaggagtggggaacaggcgaacggtccgttggtagttcggtactttagttcggtttccgttaccggggaaacgttcggggaacccgtaccgggttacccgaacccggttccgttaacgggtaaccccg

SEQ ID NO: 335639 - DNA, 750 bp, Homo sapiens
  misc_feature: GZ8MTXP01A4XI8.2.49.E05.1.454.CMB.2.raw
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcgggtacccccgggaggaggtcaccatctcttgttctggaagctatcgtaccaacagtcggaagtgaataatgtaatacgtggtaccagctacgttcccaaagacgccggacccccaagcctcctacattactaataagtaaattagtacgtaaccccggttcctacgacgggggttcccctggtaaacccgtatttccgtcgtcgggtcctaccgtaagtccgttacgggaccctaccctcgaccgtcccctaccccgtcggaccctaacgtccgtaacgggtccggggtacccttccccggggtaccggaagggtacgttcgggggaacggtccgttaaggttaacttttaagttaccgttgggtttacggtttacggggtaggttacgggggtaacctaagggccgaaacggtcccgttagggtaacgttcgggtaaccttttaaggttccggtttccggttaaccggggtaacggtaccgggggtaaccccttaccggggtacccgttaaccccgggttccgttaacggggtaaccccg

SEQ ID NO: 335640 - DNA, 716 bp, Homo sapiens
  misc_feature: GZ8MTXP01EVFPC.2.49.E05.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagaggtcaccatctnttgtctggaagcatgtccaacatcggaagtgaataatgtaatactggtaccagcagttacccaagacgccggcccccaagcctcctcatctatagtaaattatacgaacccggtcctacgacgggggtcccctgtaaacccgtattccgtcgtcgggtccctaccgtaaacggttccgtcgggaccctacccttcaccggtcccctccccgtcggaccctaagtccgtaacgggtcggggtcccgttccccggggttacccggaaggggtacgttcgggggaacggggtcctttacgggtaattttaacgtttaaccgttgggtttggtttacggggtagttcgggggaacacgggtaccaacggtcccgttagggacgtttggtaccttttaagttcggtttccgtttaccgggaaaccggttcggggaaccccgtaccgggtaccttaccccgggttaacccgttaacggggtaacccg

SEQ ID NO: 335641 - DNA, 533 bp, Homo sapiens
  misc_feature: GZ8MTXP01B0UFA.2.49.E05.1.454.CMB.2.raw
  modified_base (243)..(243): a, c, t, g, unknown or other
  misc_feature (243)..(243): n is a, c, g, or t
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcactctcctcactcactgtgcagggtcctgggcccagtctgtgctgactcagccaccctcagcgtctggtacccccggcagaggtcaccatctcttgttctggaancatgtccaacatcggaagtgataatgtatactggtaccagcagttccccaagagccggcccccaagcctccctcatctatagaaattancgaacggtctgacggggtccctagacccgtnttctctggcctcaagtctgccactcacgcctccctggcccatcagtggctccggtcgagagtggaggtctgattattacgtgtagtggtagtgggactgcagcctgagtggtctttagttcgttcgtttaacggaacgttcgggaccacggttcaacccgttcgtaacgg

SEQ ID NO: 335642 - DNA, 653 bp, Homo sapiens
  misc_feature: GZ8MTXP01BOF8L.2.49.E05.1.454.CMB.2.raw
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnagaggtcaccatctcttgtctggaagcatgtaccaanatcggaagtgataatgtatactggtaccagcagttccaagngccgccccaagcctctcatctatanaaatnagaaccgtcctgacggggtccctgaaccgtattcgtcgtgggcctacaagtctcgccaccctcacggtccctcccgtcggccctacgtccgtagggtcgggacccgttcccgggtacccggaagggtacgttagggggacgggtccgtttaggtaacttttaacgtttaacgttggtttgggtttacgggtaggttcggggacgtaacgccggtaacggtcccgttaggaggttcggtctttaaggttcggtttccgttacggggtaacgttccggggaaccccgtaccggggttacccaacccgggttccgttaacgggtaaccccg

SEQ ID NO: 335643 - DNA, 584 bp, Homo sapiens
  misc_feature: GZ8MTXP01BX3GU.2.49.E05.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (335)..(335): a, c, t, g, unknown or other
  misc_feature (335)..(335): n is a, c, g, or t
  modified_base (509)..(509): a, c, t, g, unknown or other
  misc_feature (509)..(509): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctnagcgtcgtcgggtacccccgggnaggaggtcaccatctcttgtctggaancatgtccaacatcggaagtgataatgtatacgtggtaccagcagttcccaagacgccgccccaagcctctcatctatagaaattanagtaaccggtcctcgacggggtccctgaacccgtattcctcgtcggcctccgaagttcgcggccctacctcacggtccctcccgtggccatcgaggtcgggccgtccgggtccgaggacgtgggaggtctgtaatttatacgtgtggttagagtgggactgcgaagccgttggngttgtctttagttcgttcgttacgggaaccgtcgggtaacccgtcgggtccacccggttcgttaaggtaaccccg

SEQ ID NO: 335644 - DNA, 594 bp, Homo sapiens
  misc_feature: GZ8MTXP01C749F.2.49.E05.1.454.CMB.2.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (239)..(240): a, c, t, g, unknown or other
  misc_feature (239)..(240): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (499)..(499): a, c, t, g, unknown or other
  misc_feature (499)..(499): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagaggtcacntctctgtcngannatgcanatgagnatatgtatactgtacagcacgtaccaagcgcccgaccccagcctcctactatactaataagtaaattagtacgtaacccgtcctacggtacgggtccctcgaacccgtattcgtcgtcggtcctaccgtaacgtcgtcggccctacctcgaccgtccctccgtcggaccctagtcgtaggtcgggccgttccggcggaggcgtggggtagtcttagtactttagttcgttgttggttagagtggacnggctaacggtcgttggtacgttgtacttgttcggttccgttacgggaaccgtcgggaacccgtaccggtccgttaccggttccgttggtaacccg

SEQ ID NO: 335645 - DNA, 681 bp, Homo sapiens
  misc_feature: GZ8MTXP01CA96B.2.49.E05.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (242)..(243): a, c, t, g, unknown or other
  misc_feature (242)..(243): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcacatctnttgtcngannatnacanatgagnatatgtatacgtgtacagctacgtaccaagcgcccgaccccagcctcctcatactataagtaaattagtacggtaaccccggttccgtacggtaccggggtccctacggaacccgttactttccgtccgtcggtaccctaccgtaacgtccgtacggaccctaccctccgtaccgtcccgtcccgtcggaccctacgtaccgacgggtcgggcccgttcccgggtacggagggtacgtacgggggtacggtcttagttaacgtttacgttacgttggttacggttagggtacgtagggacgtacggtccgtaacggtccgttaggtacggttcgttacgtttagttcggttccggttaccgggtaaccggtaccgggtaaccgtaccggtacccggttacccggttaaccggttaacggtaaccg

SEQ ID NO: 335646 - DNA, 592 bp, Homo sapiens
  misc_feature: GZ8MTXP01CDUGO.2.49.E05.1.454.CMB.2.raw
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnaggaggtcaccatctcttgttctggaagcatgtccaacagtcggaagtgataatgtatactggtaccagcagttcccaagcgccggacccccaagcctcctcatctatagaaattntcgaacccgtcctcgacggggtccctgaacccgtattcncgtggctccaagtctgccacctcacgcctcccgtggcctatcgagtcgggacctccgggtccgaggtacgtggggagggtcttaggtaatttacgttaccgttggttggtttaggacgttggggactacggctaacggtcccttaggtacgttggttacctttagttcgttcgttacggaacgtcgggaacctacggtccaccggtcgttaacggtcccg

SEQ ID NO: 335647 - DNA, 812 bp, Homo sapiens
  misc_feature: GZ8MTXP01DMDNF.2.49.E05.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctnagccgtcgtcggtacccccgggnagngggtcaccattcttcttgttctggaagcatcgtaccaaacagtacggaagtgaataattgtaatacgtacggtaccagcctaacgttccccaaagacggccccgacccccaagccttcctactatacttaataagtaaaatttagtacggtaacccggtcccttacgacgggggttcccctaggaaacccgttatttccgtccgttcgggtacccttacccgtaaacgttccgttcggggaccctacccgttaccgaccgtccccgttccccgtaggccctaacgttccgtaggggtccggggccgttaccccggggtaccgggtaagggtagttcggggggaacgggttcctttaagggttaactttttaacgtttaaccggttggttttagggggtttaacgggtagggttacgggggaaacctcgggtcgtaacgggttcccgttagggtacggtttcggttaccttttaaggtttcggtttacccgggtttaccggggtaaccgggttacccgggggtaaccccgttaacccgggggttccccaaccccggggttttccccgttaacgggggttaaccccccg

SEQ ID NO: 335648 - DNA, 541 bp, Homo sapiens
  misc_feature: GZ8MTXP01B8T56.2.49.E05.1.454.CMB.2.raw
  modified_base (218)..(218): a, c, t, g, unknown or other
  misc_feature (218)..(218): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (422)..(422): a, c, t, g, unknown or other
  misc_feature (422)..(422): n is a, c, g, or t
  modified_base (454)..(454): a, c, t, g, unknown or other
  misc_feature (454)..(454): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgtctggaagcatgtccaacatcggaagtgataatgtatactggtaccagcacgttcccaagacgccggacccccaagcctcctcatctatagaaattatgaacccgtcctgacggggtccctgaaccgtattctctgctcaagtctgcnctcncgcctcctgcatcngtcggctccggcagatggnggctgattattcgtgtggttcgagtggggacngcaagtcttgagttgacttagttcgttcgtttccgggaacgttcggggaaccctcggggtccacccggttccgttaagggtaacccg

SEQ ID NO: 335649 - DNA, 668 bp, Homo sapiens
  misc_feature: GZ8MTXP01ASRVB.2.49.E05.1.454.CMB.2.raw
  modified_base (221)..(221): a, c, t, g, unknown or other
  misc_feature (221)..(221): n is a, c, g, or t
  modified_base (324)..(324): a, c, t, g, unknown or other
  misc_feature (324)..(324): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagaggtcaccatctcttgttctggaagcatgtacccaacagtacggaagtgaataatgtatacgtgtaccagcagtcccaagcgccggacccccaagcctccncatactataagtaaattatacgtaacccggtcctacgacggggtcccctgaaacccgtatttcctacgtcggtcctaccgaagtcgtcggacccacctcacggccccttcccgtgggacccaagttccgaggtccgggggcccttcccggggtaccggagggtagtcggggaggtccttaggttactttagttacgttgggttgggttagggtaggtggggacctagcgaacggtcccgttagggaggttcgtacgtttacgttcggtttccggttacgggaaccgttccgggggaacccgtacgggggttcccttaacccgggttccgttaacggggtccccg

SEQ ID NO: 335650 - DNA, 775 bp, Homo sapiens
  misc_feature: GZ8MTXP01A05IX.2.49.E05.1.454.CMB.2.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctnagccgtctcggtacccccggaggaggtccaccatctcttgtctggaancatcgtaccaactagtcggaagtgaataatgtaatacgtggtaaccagcacgttcccaagcgcccggacccccaagcctcctcatactataacgtaaattagtacggtaaaccccggttccctacggtaacgggggttcccctaggtaaacccgttactttccgtcgttcgggtacccttaccccgtaaacggttccgtacgggaccctaccccgtttccgaaccggtcccccttccccgttcgggacccctaacgtttcccgacggggttccggggtaccccgttaccccgggggtaccggtaagggtacgttacgggggaacggggttccttacgggtaaactttttaagttaaccgttggttagggttttacggggaggttacgggggaaacctcgggaccgtaacggtcccgtttagggtacggttgttccgtttaaggttcgtttcccggtttaaccgggtaacggttaccggggaacccctaccggggttccgaccccggtttccgttaacgggtaaccccg

SEQ ID NO: 335651 - DNA, 621 bp, Homo sapiens
  misc_feature: GZ8MTXP01A91H1.2.49.E05.1.454.CMB.2.raw
  modified_base (219)..(219): a, c, t, g, unknown or other
  misc_feature (219)..(219): n is a, c, g, or t
  modified_base (336)..(336): a, c, t, g, unknown or other
  misc_feature (336)..(336): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgtctggaagcatgtccaacagtcggaagtgaataatgtatactggtaccagcacgtcccaagacgccggaccccaagcctctacatctatagtaaattntacgaacccggtcctcgacggggtccctgaacccgtattctcgtcggcctaccgaagtcctggaccaccctcacgtcccctcccgtcggaccctagtcgtagggtcgggcccgttcccgggtaccgagggtactgggggacggtcttagtagtttacttacgtggttgttagggagttcggggactacggcgaaggtccgttggtagttcgtactttagttcggttcgttacgggaacggtcgggaacccgtccggtccgaacccgttccgttaacggtaacccg

SEQ ID NO: 335652 - DNA, 759 bp, Homo sapiens
  misc_feature: GZ8MTXP01CNEN0.2.49.E05.1.454.CMB.2.raw
  modified_base (222)..(222): a, c, t, g, unknown or other
  misc_feature (222)..(222): n is a, c, g, or t
  modified_base (348)..(348): a, c, t, g, unknown or other
  misc_feature (348)..(348): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtcgtcgggtaccccccgggnaggacggtcacctatctcttgttctggaagcatgtccaacagtacggaagtgaataatgtatactggtaccagcagttcccaagacgccggacccccaagcctcctacatactaataagtaaattntacggaaaccccggttcctacggacgggggttcccctaggaaaccccgttatttccgtcgtacgggtcccttaccgtaaggtccttcgggaccctaacccgtcgtaaccggtcccccttcccgtacgggtaccctaagttcccggtaagggttccgggggtacccgttccccgggggtaaccggaaggggtacgttaggggggacggggtccttaggttaattttaacgttaccgttggggttggtttaggggaacggttcgggggaactacggccgtaacggtcccggttaggtcggttacgttacgtttacggtttccgggttccgtttaaccgggggtaaccgttaccgggggtaacccctacggggttaccccgttaaccccgttcggttaaccgggtaaccccggg

SEQ ID NO: 335653 - DNA, 717 bp, Homo sapiens
  misc_feature: GZ8MTXP01EKDIK.2.49.E05.1.454.CMB.2.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
tcagacgctcgacacacgaccggtgctcgatttagagcgactagcaacacacgaaagggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtcgtcgggtaccccggnaggaggtcaccatctcttgtctggaagcatcgtacaacagtacggaagtgaataatgtaatacgtcgtaccagctacgtacccgaagacggcccgacccccaagtcctacctactatactaaattaacgtaaatttacgacgtaaacccggtcctacggtacggggtccctagaaacccgtattccgtcgtcggcctaccgaacgttcgtacggaccctacctcgaccgcccctccgtcggacctacgtacgtacggtcggggtcccgtccgggtaccgaaagggtcgtacgggggaaggttccgttagttaacgttttacgttacgttgggttgggtttaagggaggttacgggggtaactacggggcctaacggtcgttagggtacgtttaggtacgttttaagttcggtttccggttaccggggtaaacccggttcggggtaacccgttccgggtacccggttaccccggttccggtttaacgggtaaccccg

SEQ ID NO: 335654 - DNA, 628 bp, Homo sapiens
  misc_feature: GZ8MTXP01ENYUI.2.49.E05.1.454.CMB.2.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtcgtcggtacccccggnagaggtcaccatctcttgtctggaancatgtcaacatcggaagngataatgtatactggtaccagcagttacccaagacgccggacccccaagcctcctcattctataagtaaattatagtaacccggtcctacgacggggtccctcgaaacccgtattccgtcttgggcctccgaaagtcctggccacctcacgccctccctggaccctagtcaggtcgggcctcccgggtaccgagggtatcgggaagggtctagtaactttagttaacgttggttagtttagggagtagggggaacctaggcgaacggtcccgttagggagttcgtaccgtttaattcgggttcgttaccgggaaacgttcgggaacccgtacggtccgaccggttccccgttaagggtaaccccg

SEQ ID NO: 335655 - DNA, 726 bp, Homo sapiens
  misc_feature: GZ8MTXP01CG5T0.2.49.E05.1.454.CMB.2.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctnagcgtctcggtacccccggaggaggtccacctatctcttgttcnggaagctatgtccaacagtcggaagtgataatgtatacgtgtacccagcacgttaccccaagacgccggacccccaagcctcctacatactaataagtaaattgtacgaaccccggttcctacgacggggtccctacggaacccgtactttcctcgtcgggtacctaccgaaaggttcctcgggccctaacccttccgaaccggtcccctccccgtacgggaccctacgtaccggtacgggttccgggtaccgttccccggggttacccggagggaccgttaggggggtacggggtactttaggttaaacctttttaagtttaccggttacggtttaggtttacgggggtacgttagggggaccctaaggtaccgaacggtcccgttagggtacgttcgggtaactttcgttcgtttccgttacgggtaaccggttacgggaacccgtacgggtccttaccccggttcgttaacggtaacccg

SEQ ID NO: 335656 - DNA, 808 bp, Homo sapiens
  misc_feature: GZ8MTXP01DJQ9Y.2.49.E05.1.454.CMB.2.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagccgtctcgggtaccccgggnagaggtccaccatctnttgttctggaagcatcgtaccaaacagtacggaagtgaataatgtatactaggtaccagcacgttacccaagacgcccgaccccaagcctcctcatactaataagtaaattagtacgtaaaccccggtcctacggacggggtccctaggtaacccgtatttccgtcgtcgggtacccttacccgtaaacggttccgttcgggacccctaaccccgttccaaccggtccccccttccccgttcgggacccctaaacgttccggtaacgggttccggggtccccgttaccccggggtacccggaaggggtaacgtttccggggggaaagggttcccgtttaaggttaacgttttaaccgttttaacggttgggtttagggtttaagggggtaaccgttaggggggtaaacctaacgggtcccgaaacgggttcccgttagggttaagggtttcgttaaccggtttttaagttccggggtttcgttttaaacccggggaaaccgggttcgggggtaaccccctaacgggggtttcccaacccccgggtttccgttaaccgggggttaaccccg

SEQ ID NO: 335657 - DNA, 788 bp, Homo sapiens
  misc_feature: GZ8MTXP01CHKIJ.2.49.E05.1.454.CMB.2.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacgaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnaggaggtcaccatctcttgtctggaancatgtccaacatacggaagtgataatgtatactggtaccagcacgttcccaagacgccggacccccaagcctcctacatactataagtaaattacgtgaaaccccggtcctacgacgggggtcccctaggaaacccgttatttcccgtcgttcgggaccttacccgtaaacgttccgtacgggaccctaacccttccaccggtcccctccccgtcgggacccctagttacccgaaggggttcggggacccgttccccggggtacccgggaaagggtaaccgttgggggaaacccggggtttacgtttaacggttaaacgttttaaacggtttaccggttaggggtttacggggtttaagggggtaacggttaacgggggtaaccgtacgggtaaccgtaacgggttcccgttaggggtacggtttacggttaacgtttaacggtttacgggtttaccggtttaccgggttaacccgggttaccggggtaacccggtaacccgggtacccggttaccccggttaacccggttaaccggtaaccgg

SEQ ID NO: 335658 - DNA, 752 bp, Homo sapiens
  misc_feature: GZ8MTXP01AHOQL.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtacccccgggnaggacgggtccaccattcttcttgttctggaagcatcgtaccaacagtacggaagtgaataatgtatacgtggtaccagcacgttacccaagacgcccggaccccaagcctcctacactactaataagtaaattacgtacggtaaaccccggtcctacggtaacgggggttcccctacggtaacccgtatttcccgtcgtcgggtaccttacccgtaacgttcgtacgggaccctacccgtaccgaccgtccccgtaccccgttcggaccctacgtacgtacgggtccggggtcccgttcccgggtaccggaggtacgtgggggacggtacgttagtaactttagtttacgtggttaggttagggtaggttcggggaacaggtccgtaacggtcccgttagggtacggttacgttacgttttaacgttcgggtttaccggtttaccggggaaacccgggttaccgggggtaaccccgttaccgggggttacccgttaaccccgggtttcccggttaaccgggttaaccccg

SEQ ID NO: 335659 - DNA, 542 bp, Homo sapiens
  misc_feature: GZ8MTXP01BNPJI.2.49.E05.1.454.CMB.2.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagagggtcaccatctcttgttctggaancatgtccaacatcggaagtgataatgtatactggtaccagcagttcccaagagcggcccccaagctcctcatctatagaaattatgaaccggtcctcgaggggtccctgaacccgattctctggctcaagtcngcacctcagccctcctcggccatcaggtcgggcctccggtccggaggatggggaggtctgatttagttactggttgttggatggggacagcaagccttggagttgtcttattcgttcttacgggaacgtcggggaaccacgggtccaccgtccgttaaggtccg

SEQ ID NO: 335660 - DNA, 778 bp, Homo sapiens
  misc_feature: GZ8MTXP01CN52N.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccggnaggacggtccacctatctcttgttctggaagctatgtccaacagtcggaagtgataatgtaatacgtagtaccagctacgttccccgaaagaccggacccggtccccccaaagtcctaccctactaactaccttaataaacgtaaaattagtacggtaaacccccggttcccgtacgtacgggggttcccctacggaaacccgttacttccgttacgtcgggtacccttacccgaaacgttcccgtacgggtaccctacccgttaccgaccggtcccccttccccgtccgggaccctaacgttcccgtaacggggtcgggggtccctaccccggggttacccggaaggggtacgttacgggggaacggtccgtttaggttaaattttaaccgtttacgttcgggtttagggtttacgggtaaacgttgggggaaacctaccggacgtaacggtcccgttgggttacgttcgttacctttaggttcgttcggttacccggtaaacgggtcgggtaaccccgtacggtacccgacccgttaaccgttaacgggtaaccccg

SEQ ID NO: 335661 - DNA, 578 bp, Homo sapiens
  misc_feature: GZ8MTXP01AE48J.2.49.E05.1.454.CMB.2.raw
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtccaacatcggaagtgataatgtatactggtaccagcagttcccaagacgccggcccccaagcctcctcatctatagaaattangaaccggtcctgacggggtccctgaacccgtattctctggctccaagtctggccacctcacgccctccctggcccatcaggtcgggcctccgggtccgaggtatggggaggctggtatttattacgtggttggttggagttggggaccagcgaagccttgggagttgtactttagttcggttccgtttacgggaacgttcggggaacccgtacgggtccacccggttcgttaacggggtcccg

SEQ ID NO: 335662 - DNA, 656 bp, Homo sapiens
  misc_feature: GZ8MTXP01B0LFA.2.49.E05.1.454.CMB.2.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgtctggaancatgtaccaacatcggaagtgataatgtatactggtaccagcagtcccaagcgccggacccccaagcctcctcatctataagtaaattntacggtaacccggtcctacgacgggggtcccctaggaaacccgtatttcctcgtgggccctaccgaagttcgtcgggacccacccttcacgtccctcccgtcggccctaagtccgagggttcggggccgtcccgggtaccgaagggtacgtggggacggtcgttaggtatttacgttacgttggttggtttagggagttcgggggacctaggccgtaacggtccgttggtaaggttcgtacgtttagttcggttccgttaccgggtaaacgttcggggaaccctaccgggtccgttacccggttccgttaacgggtaacccg

SEQ ID NO: 335663 - DNA, 609 bp, Homo sapiens
  misc_feature: GZ8MTXP01E04YV.2.49.E05.1.454.CMB.2.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtaccccggnaggaggtcaccatctcttgtctggaagcatgtaccaacagtacggaagtgaataatgtaatacgtggtaccagcagttcccaaagcgccggaccccaagcctctacatactaataagtaaattagtacgtaaccccggtcctacgaacgggggtccctaggaaccctattctcgtaggctacccaagtctggaccacctcacgtccctcctggccctaagtcgaggtcgggcctcccgggtacgaggagttcggggaggtcgttagtaacttagttacgttgtggttaggagtgggacagcgtaagccgttgtagttgtacttagttgttcgttacgggtaacgtacgggtaacccgtaccgggttccgacccgttccgttaacgggtcccg

SEQ ID NO: 335664 - DNA, 684 bp, Homo sapiens
  misc_feature: GZ8MTXP01D7XIX.2.49.E05.1.454.CMB.2.raw
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (387)..(387): a, c, t, g, unknown or other
  misc_feature (387)..(387): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagaggtcaccatctcttgttctggaagcatcgtaccaacagtcggaagtnataatgtatactggtaccagcacgttccaagngcccgaccccaagcctcctacatctaataagtaaattagtacgaacccggtcctacggacggggtcccctaggaacccgtatttccncgtcggcctaccaagtcgtcggcctaccctcgaccgtcccgttccccgtacgggaccctaacgtcggtaacgggtccggggcccgttcccggggtaccggaagggtaacgttggggggtaacgggtcgttaggttaaacttttagtttaacgtgggtttggtttagggagttgggggaacgcggtcgaacggtcccgttagggtcgttgtaccgtttaagttcggttccgttacggggaacgttcgggggaaccctaccggggtaccttaacccgggttccgttaacgggtaacccg

SEQ ID NO: 335665 - DNA, 760 bp, Homo sapiens
  misc_feature: GZ8MTXP01DEFWT.2.49.E05.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtctcgggtacccccgggnaggaggtcacatctcttgttcnggaagcatgtaccaacagtacggaagtgataatgtaatacgtggtaccagcctacgttcccaagacggccccggacccccaagcctcctactatctaataagtaaattagtacgaaacccggtccctacggtacgggggtcccctacggtaaacccgtatttcccgtacgtcggggtacccttaccgtaaggttcctacgggaccctaacccttccgaccggtccccctccccgtcgggaccctaagtccgtacgggttccggggaccccgttccccggggtacccggaagggtacgtacgggggtaacgggtccgtttaacggttaattttaacgtttaaccggtttggggtttagggtttacggggtaacggttagggggtaaccgacgggtcgaaacgggtcccgttagggtaaggttcggttaccgtttaagttcggttccgttaccgggtaaacggtcggggtaacccgtaccggggtcccttaacccggttccgttaacgggtaacccg

SEQ ID NO: 335666 - DNA, 696 bp, Homo sapiens
  misc_feature: GZ8MTXP01APGLB.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccggnagaggtcaccatctcttgttctggaagcatgtccaaacatcggaagtgataatgtatactggtaccagcagttcccaagacgccggcccccaagcctcctcatactataagaaattagtagtaaccccggtcctcgacgggggttcccagaacccgtattcctcgtcgggtcctaccgaagttcgtcgggcccaccccttcgaccgtcccctccccgttggcccaattccgaggtccggggtccttccccggggttccgaagggtagtcggggaacggtccgttaggtaattttacgttacgttgggtttacggttaggggtacggttggggaccgaaggggtccctaacggtcccgttaggaacggtttgtaccgttttaagttccgggtttaccggttacccggggtaaaccggttcggggaaaccccgttccggggtacccttaacccgggttcccggttaacgggtaaccccg

SEQ ID NO: 335667 - DNA, 631 bp, Homo sapiens
  misc_feature: GZ8MTXP01D4M1P.2.49.E05.1.454.CMB.2.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (492)..(492): a, c, t, g, unknown or other
  misc_feature (492)..(492): n is a, c, g, or t
  modified_base (541)..(541): a, c, t, g, unknown or other
  misc_feature (541)..(541): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtaccccgggcagagggtcaccatctcttgtctggaagcatgtaccaanatacggaagtgaataatgtatactggtaccagcagttcccaagcgccggccccaagtctcctcattctataagaaattatacgtaacccggtcctacgaacggggtccctaggaacccgtattcgtcgtcggtacctccgtaagttccgtacgcctaccctctaccggtccccttcccgtcggaccctaagtccgtaggtcggggaccgttcccgggtacgagggtagtcgggggnggtacttggtaatttagttacgtggttagttagggagttaggggaaccncggcgtaacgtcgttaggtacgttcgtgttacgttcgttcgttacggtaacgtacggtaaccgtacggtccgaccgtccgttaacggtcc

SEQ ID NO: 335668 - DNA, 575 bp, Homo sapiens
  misc_feature: GZ8MTXP01BG6RJ.2.49.E05.1.454.CMB.2.raw
  modified_base (218)..(218): a, c, t, g, unknown or other
  misc_feature (218)..(218): n is a, c, g, or t
  modified_base (496)..(496): a, c, t, g, unknown or other
  misc_feature (496)..(496): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtaccaacatcggaagtgataatgtatactggtaccagcagttcccaagacgccggacccccaagctcctcatctatagaaattatgaacccgtcctacgacggggtccctaggaacccgtattcgtctgggcctaccaagtctggccaccctcacgccctcccgtggcccagtcgaggtcggggccttccgggtccgaggagtggggaaggtctagtatttattacgtgttggttggagtgggacngcgaagccttggagttgtcttattgttcgttacgggaacgtgggaaccctacgggtccacccggtcgttaacgggtccg

SEQ ID NO: 335669 - DNA, 762 bp, Homo sapiens
  misc_feature: GZ8MTXP01B0HQP.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtccaacatcggaagtgataatgtatactggtaccagcagttcccaagacgccgacccccaagcctcctcatctataagtaaattatacggtaaccccggtcctacgacgggggtcccctaggaacccgtatttccgtacgtcgggtacccttacccgaaaggttccgtacgggaccctaacccgttcgaaccggtcccccttcccgttcgggacccctaaacgtccgtaacgggttcgggggtcccgttccccggggttacccggaagggtaaccggttggggggaaacggggttccgttaggtaaacgtttttacgtttaacccgtttggggtttacggtttaggggaacggtttggggggtaaacctacgggtacccgaacgggtccccgttaggggtaacgttcggtaccgttttaagttcggtttccggtttaccggggtaaacggttccgggggaaccccttacggggttacccttaccccgggttccgttaaacggggttccccg

SEQ ID NO: 335670 - DNA, 647 bp, Homo sapiens
  misc_feature: GZ8MTXP01AC2QA.2.49.E05.1.454.CMB.2.raw
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (246)..(247): a, c, t, g, unknown or other
  misc_feature (246)..(247): n is a, c, g, or t
  modified_base (253)..(253): a, c, t, g, unknown or other
  misc_feature (253)..(253): n is a, c, g, or t
  modified_base (258)..(259): a, c, t, g, unknown or other
  misc_feature (258)..(259): n is a, c, g, or t
  modified_base (275)..(275): a, c, t, g, unknown or other
  misc_feature (275)..(275): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttcccctctcctcctcaccctcctcactcactgtgcagggtcctgggcccagtctgtgctgactcagccaccctnagcgtctcgggtacccccggnagacggtcactntctnttgtcgnganntcacangtgannatatgtatacgtgacngctacgtaccagcgcccgaccccatcctctacatactagtaagtaattagacggtaaccccgttccgcggtaccgggtccctacgtaaccttcttctcgtcgtctaccgtagtctcgccacctcgcgtccctccgcgaccacgtcgtacgggtccgggtccgtccgggtacggaggtacgtgggggacggtcttagtaacgtttagttcggttggttacgggtaggtacggtacggggaccgtacggtcgtaaccggtcgttgggtacgttcgttacgtttaggttccggttacccggttaacgggtaacccggttaccggggaaccccgtaccgggtacccgttacccggttccggttaaccggtaacccg

SEQ ID NO: 335671 - DNA, 620 bp, Homo sapiens
  misc_feature: GZ8MTXP01CUPGD.2.49.E05.1.454.CMB.2.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtctcggtacccccgggnaggagggtccaccatctcttgttctggaagcatcgtaccaanagtcggaagtgaataatgtatacgtggtaccagcacgtcccaagcgcccggaccccaagcctcctcatctataagaaattgtacgaacccgtcctacgacggggtccctagaacccgtattctcgtggcctacgaagtctgccctacctcacgtcccctccgtcggccctagtcgaggtcgggcctcccgggtacggaggagtacggggaggtccgttaggtaacttttaacgtttaccgtggttaggttagggtagtcggggacaggtccgaagtccttaggtacgttgtacttagttcgttcgttcgggtaacgtcgggaacctacggtccgttaccgtccgttaacggtaacccg

SEQ ID NO: 335672 - DNA, 693 bp, Homo sapiens
  misc_feature: GZ8MTXP01ASTLH.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnagaggtcaccatctcttgtctggaancatgtccaacatcggaagtgataatgtatacgtggtaccagcagttcccaagcgccgaccccaagctcctcatctataagtaaattagtacgtaacccggtcctacgacgggggtcccctaggaacccgtatttccgtcgtcgggtacccttacccgtaaacgttccgtacgggtaccctaccccttcgaccgtccccttccccgtcgggaccctaacgttccgaagggttccggggtcccgttccccggggtaccggaaggggtaacgttcgggggaaacgggttccgttaaggttaacttttaacgtttaccgttgggttaggtttagggagttacgggggaccagggtcccgaagtccgttagggtagttggttaccttaagttcgttccggttacgggaacgttcgggaaccgtaccggtcacccggttccgttaaggtaacccg

SEQ ID NO: 335673 - DNA, 658 bp, Homo sapiens
  misc_feature: GZ8MTXP01CBBYS.2.49.E05.1.454.CMB.2.raw
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (575)..(575): a, c, t, g, unknown or other
  misc_feature (575)..(575): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcagggtcctgggcccagtctgtgctgactcacgcccacctnagcgtctcgggtaccccggnagaggtcacatctcttgtcnggancatcgtcaacngtacggaagtgatagtgtatacgtggtaccagctacgtacccaagacgcccggtacccccaagtcctacctacaacttactaattaagaaatttacgtacggtaaaccccggttcctacggaccgggggttcccctacggaacccgttactttccgtcgtccgggtacctaccgtaagttccgtacgaccctacccgttccgaccggtccccgttcccgtcgggaccctacgttccgacgggtcgggcccttccggggaccgaggtagtggggacggttctaggttatttacgttagttggtagttggaagtggggaacncggccgaagtcgttggtagttcgttattagttcgttccgttacggtaacgtcgggaacctacggtcacccgtcgttaagcccg

SEQ ID NO: 335674 - DNA, 703 bp, Homo sapiens
  misc_feature: GZ8MTXP01CVVHM.2.49.E05.1.454.CMB.2.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (243)..(244): a, c, t, g, unknown or other
  misc_feature (243)..(244): n is a, c, g, or t
  modified_base (264)..(264): a, c, t, g, unknown or other
  misc_feature (264)..(264): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccacctcagcgtctggtacccccgggnaggacggtcacntctnttgtcnggannatcgacaacagtacggaagnataatgtatactgacagctacgtaccaagacgcccgaccccaacgtctcctacatactaataagtaaattagtacggtaaccccggtccgtacggtacggggtccctacggtaaacccgtactttccgtcgtacggtacctaccgtaacgtcgtacgaccctacccgtacgaccgtcccctcccgtcggacctacgtccgtacgggtccgggtcccgttcccgggtacggaggtacgtagggggtacggtcgttagttaactttaagttacgttggttaggttagggtaacgtacgggaacgtacggcgtaacggtaccgttacggtacggttacgttacgtttacgtttacggtttccggttaccgggttaaccgggtaccgggtaacccggtacccgggtacccggttacccggttaacccggttaaccggtaaccg

SEQ ID NO: 335675 - DNA, 618 bp, Homo sapiens
  misc_feature: GZ8MTXP01BGSUD.2.49.E05.1.454.CMB.2.raw
  modified_base (218)..(218): a, c, t, g, unknown or other
  misc_feature (218)..(218): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagaggtcaccatctcttgtctggaagcatgtaccaacatacggaagtgaataatgtatacgtggtaccagctacgttacccaagacgcccggacccccaagcctcctacattctataagaaattatacggtaaaccccggtcctacggaacgggggtcccctacggaacccgtatttcctcgtcgggcccttaccgaagttccgtcgggccctaaccctcgaccggccccttcccgtcggaccctatccgtaggtcgggccgttcccgggtcgaggtctggggacggtctagtatttatacgtgttgttaggntgggacngcaagtcttggagttgtctttagttcgttcgttacggtaacgtcgggaacctcggtcacccgttcgttaacggtaacccg

SEQ ID NO: 335676 - DNA, 737 bp, Homo sapiens
  misc_feature: GZ8MTXP01CQAO1.2.49.E05.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctnagcgtcgtcgggtacccccgggnaggacggtccacctntctcttgttcaggaanctatcgtaccaacagtacggaagtgaataatgtaatacgtggtaccagctacgttacccgaagaccgcccggacccccaagcctacctactatactaataagtaaattcgtacggtaaacccccggttcctacggtaccggggttcccctacggtaacccgttatttcccgtacgtcgggtacccttacccgtaacgttccgtacgggaccctacccgttccgaccgttcccctcccggttacggaccctacgttccggacgggttccggggtcccgttcccgggtaccggagggtacgttcgggggtaacggtcgtttagtagttttaacgttacgttgggttggtttacgggagttcggggaactacggcgtaacggtccgttaggtacgttcgttacgtttagttcggtttccgttacgggaacggttccggggtaacccgtaccgggttaccgacccgggttcgttaacgggtaacccg

SEQ ID NO: 335677 - DNA, 772 bp, Homo sapiens
  misc_feature: GZ8MTXP01CTP45.2.49.E05.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtcgtcggtacccccgggaggacggtcaccatctcttgtcnggaancatgtccaacatacggaagtgataatgtatacgtggtaccagcacgttcccaagacgccggacccccaagcctcctacatctaataacgtaaattagtacgaaacccggttcctacggacggggttcccctaggaacccgttattcctcgttcgggacccttaccgaaacggttcgttacgggcctaacccttcaaccgtccccttccccgtgggacccctagttacccgtagggttccgggtcccgttcccggggttacccgaaggggtactgggggtacggtacgttagttaaacgttttagtttaaccggtggtttacgggtttacgggtaaggtttaccgggggaacgaaacggtccgtaaacgggttcccgttagggttaaccgggttcgttaaccgttttagtttccgggtttccgtttaacccgggggaaaaccggttttccgggggaaacccccgttaccggggggttacccttaccccgggggtttaaccccgtttaacgggggtaaacccccgg

SEQ ID NO: 335678 - DNA, 767 bp, Homo sapiens
  misc_feature: GZ8MTXP01DF14G.2.49.E05.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (341)..(341): a, c, t, g, unknown or other
  misc_feature (341)..(341): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgttcnggaagcatcgtaccaacatacggaagtgataatgtaatactggtaccagcacgttcccaagacgcccggacccccaagcctcctcatctatagaaattncgtaaccgtcctacgacggggtccctgaacccgtattcctcgtcgggacccttacccgaaagttccgtagggacccctaacccgttcgaaccggtccccttccccgtcggggacccctaacgttccggtaacgggttccgggggacccgttccccgggggttaccccgggaaaggggtaaccggtttggggggaaacggggttccgtttaagggttaactttttaaacgtttaacccggttgggtttcgggtttaacggggtaaggttcgggggaacctacgggccgtaaacgggtcccgttagggtaacggtttcggtaccgtttttaagttcgggtttccgtttaaccgggggtaaaccgttaccgggggtaacccttaccggggtacccttaacccgggtttcccgttaacgggttaaccccg

SEQ ID NO: 335679 - DNA, 816 bp, Homo sapiens
  misc_feature: GZ8MTXP01BRV8R.2.49.E05.1.454.CMB.2.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtcgtcggtacccccgggnagacggtcaccatctcttgtctggaagcatgtaccaanatacggaagngataatgtatactggtaccagcacgttcccaagcgccggacccccaagcctccacatctaataagtaaattagtacggtaacccggtcctacgacgggggtcccctaggtaaacccgtacttctacgtcgggtctacccgtaaggttccgtacgggccctacccgttcgaccggtccccccgtcccgttacgggaccctaacgttaccgggtaggggtttcccgggggaccccgttaccccgggggtacccgggtaaaggggtaccggttaggggggtaacggggttccgtttaagggttaattttttaaccggttaaccgtttgggggttttaccggggttttagggggaggttaacgggggaaccgaacgggtcccgtaaacggttccccggttagggttaacggtttcgggttaaccctttttgggttaccgggttttccgggttttaacccggggaaacccggggtttccgggggtaaccccgtaaccgggggtttaccccggttaaccccgggtttaaccccggtttaaggggtaacccccgg

SEQ ID NO: 335680 - DNA, 560 bp, Homo sapiens
  misc_feature: GZ8MTXP01DQMUJ.2.49.E05.1.454.CMB.2.raw
  modified_base (217)..(217): a, c, t, g, unknown or other
  misc_feature (217)..(217): n is a, c, g, or t
  modified_base (398)..(398): a, c, t, g, unknown or other
  misc_feature (398)..(398): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagaggtcaccatctcttgttctggaagcatgtccaacatcggaagtgataatgtatactggtaccagcagttccccaagacgcggcccccaagcctcctcatctatagaaattatgaaccggtcctcgaggggtccctgaacccgattctctggctccaagtctggcacctcagcctcccnggcccatcagtcggcctccggtcgaggagtgggaggctgtattattacgtgtggttggatggggactggcaagtccttaggtagttgtcgtttagttcgttccgttaccgggaacgtcggggaaccctacgggttccacccggttcgttaacgggtaacccg

SEQ ID NO: 335681 - DNA, 694 bp, Homo sapiens
  misc_feature: GZ8MTXP01EW74N.2.49.E05.1.454.CMB.2.raw
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgtctggaagcatgtaccaacagtacggaagtgaataatgtaacttacgtcggtaccagcagttaccccaagacgccggacccccaagcctcctacattctaataacgtaaattagtacggtaaaccccggttccgtacgtacgggggtcccctacggaaacccgtattccgttcgtcgggtccctacccgtaagttccgtacgggccctaacccttcgaccggtcccttccccgtcgggccctaacgttcgtaacgggtcgggccgttccccgggtacggaggtacgtggggacggtcgttagtactttaagtttacgtggttaggttaggaggttagggacgaggacccgaaggtcccttagggtacgttcggtactttaagttcggttccgttacgggtaacccggttgggaacccgtaccgggtccacccggttccgtttaagggtaaccccg

SEQ ID NO: 335682 - DNA, 666 bp, Homo sapiens
  misc_feature: GZ8MTXP01EYE62.2.49.E05.1.454.CMB.2.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
  modified_base (409)..(409): a, c, t, g, unknown or other
  misc_feature (409)..(409): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcaggtcctgggcccagtctgtgctgactcacgccaccctnagcgtctcggtacccccgggnagaggtcaccatctcttgttctggaagcatcgtaccaacatacggaagngaataatgtaatacgtggtaccagctagttacccaagacgccggaccccaagcctcctcatctataagtaaattatagtaaccccggtcctacggaccggggtccctacgaaccgtattcctcgtgggcctacaacgttcncgggaccaccctcgacctccctcccgtcggacctacgtcgacgggtcgggtaccgtcccgggtacgagggacttggggaagggtccttaggtacttttaagttacgttgggtttaggttaggtacggtcggggaacacggtcgaacgtccgttagggacggttctaccgtttagttccggtttcgttaaccggggtaacggttaccgggtaacccgtaccggttcccgaacccgggtttccgttaacggtaacccgg

SEQ ID NO: 335683 - DNA, 619 bp, Homo sapiens
  misc_feature: GZ8MTXP01D0BGE.2.49.E05.1.454.CMB.2.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtcgtcggtaccccggnagaggtcaccntctcttgtctggaancatgtccaacatcggaatgatatgtatactggtaccagcacgttcccaagcgcccggaccccaagcctcctcatctaataacgtaaattgtacgtaaccggtcctacgtacgggggtccctggaacccgtattcgtacgtcgggtacctaccaaggtcgtacggccctacccgtcaccgtcccctccgtaggccctagtcgaggtcggggccttaccgggtccgagggtacgttggggaacggttcttagtatttaacttcgtggttggttaggagtggggacaggctaacgtcgttggtacgttgtcttagttcggttcgttaccgggaagttcgggaacctcggtaccgttaccgttccgttaacgtaacccg

SEQ ID NO: 335684 - DNA, 619 bp, Homo sapiens
  misc_feature: GZ8MTXP01DC0M2.2.49.E05.1.454.CMB.2.raw
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctnagcgtctcggtaccccggnagaggtcaccatctctgttctggaagcatgtaccaacatacggaagtgataatgtatactggtaccagcacgttcccaagacgccggaccccaagcctcctcatctaatagaaattatgaacccgtctacgacggggtccctagaacccgtattctctcgggaccttaccgaacgtcgtcggccctaccctcacggtcccctcccgtcggccctaagtccgaggttccgggggccttcccggggtaccgagggtacttgggggaacggtctagaactttacgttacgtgttggttaggagttggggacagtccgaagtccgttaggtagttgttactaagttcggttcgttacggtaacgtcggggaaccctacgggtccttacccgtccgttcggtaacc

SEQ ID NO: 335685 - DNA, 689 bp, Homo sapiens
  misc_feature: GZ8MTXP01D65PX.2.49.E05.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagaggtcaccatctnttgttctggaagcatgtccaacatacggaagtgataatgtatactggtaccagcagttacccaagacgccggacccccaagcctcctcatctataagaaattatacgtaacccggtcctcgtacggggtcccctaggaaacccgtattccgtcgtcggtacctaccgtaacgttcgtcggaccctaccctcgaccggtcccctccccgtcgggtaccctaacgtccgtagggtccggggtccttccccggggtaccggaagggtaccgttgggggacggtaccgttaggttaaatttacgttaaccgttgggttagggttagggtacggttagggggaaccacggcgtaacggtcccgttaggtagtttcgtacgttttaagttcggtttcgttacgggtaaccggttacgggaacccttaccgggtccttaacccggttcgttaacggtaacccg

SEQ ID NO: 335686 - DNA, 792 bp, Homo sapiens
  misc_feature: GZ8MTXP01DTQZ6.2.49.E05.1.454.CMB.2.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggagaggtcacntctnttgtcnggaancatgtccaanagtacggaagtgaataatgtaatacgtggtaccagcagtcccaagacgccccggacccccaagtcctcctactatctaataagtaaattatacggtaaaccccggtcctacggacgggggtcccctaggaaacccgtatttccgtcgtcgggtacccttacccgtaaagttccgtcgggaccctaacccgttcgaaccggtcccccttaccccgttgggacccctaagttccgtaacgggttccggggcccgtttccccgggggtacccggaaagggtccggttaggggggtaaccgggttccgttaacgggtttaatttttaaccgtttaaccggttggggtttaagggtttaggggtaaccggtttgggggaaacctacgggaccgtaaacggtcccgtttagggtaaccggtttgttaccgttttaaggttccgggtttccggttttaaacccgggggaaaccggttaccgggggtaaccccgttaaccggggtccccgttaaaccccgggtttcccgttaacgggggttaaccccg

SEQ ID NO: 335687 - DNA, 693 bp, Homo sapiens
  misc_feature: GZ8MTXP01AW5RR.2.49.E05.1.454.CMB.2.raw
  modified_base (200)..(200): a, c, t, g, unknown or other
  misc_feature (200)..(200): n is a, c, g, or t
  modified_base (445)..(445): a, c, t, g, unknown or other
  misc_feature (445)..(445): n is a, c, g, or t
  modified_base (549)..(549): a, c, t, g, unknown or other
  misc_feature (549)..(549): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctnagcgtctcgggtacccccggagacggtcaccatctcttgttctggaagctatgtaccaacagtacggaagtgaataatgtaatacgtggtaccagcctaacgttccccaaagcgccccggacccccaaagtccctcctcaatcgtaattaagtaaattcgtacggaaaccccggttcctacggtaaccgggggtccctacgaaacccgtactttcgtccgtgggtcccttacccgaaggttccgngggtaccctacccgttcaccggtccccttccccgtggaccctacgtcgtacggtcgggccttccgggtacgagggtactggggacgtctagtatttagttacgnggttaggttcggatgggggacacgctaacggccgttagggtacgttcggttaccgttagttccggtttcggtttaccccgggaacgtttccggggaacccgttacccggggtcccttacccgggttccgttaacggggtccccg

SEQ ID NO: 335688 - DNA, 702 bp, Homo sapiens
  misc_feature: GZ8MTXP01CWAW4.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcgggtacccccggnagaggtcaccatctcttgtctggaagcatgtaccaacagtcggaagtgaataatgtaatacgtggtaaccagctacgttacccaaggacgcccggacccccaagcctcctactatactataagaaatttctacgaacccggttcctacggacggggttcccctgaacccgtatttccgtctacgggcctacaagttctcgggaccctaccttccgaccgtccccgttcccgtcgggaccctaacgttccggtagggttccgggggtcccgttccccggggttaccggaagggtaccgtgggggtaacggtccgttaggttaactttaacgttaccgttggttcggtttaggggagttacgggggacacgcggtaacggtccgttgggtaacggttcgttacgtttacgttcggtttacggttaccgggaacgtcggggtaacctaccggggtaccttacccgggttcgttaacggtaacccg

SEQ ID NO: 335689 - DNA, 620 bp, Homo sapiens
  misc_feature: GZ8MTXP01BSKXC.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnagacggtcaccatctcttgtctggaagcatgtccaacatacggaagtgataatgtatacgtggtaccagcagttcccaagacgccggaccccaagctcctcatctataagtaaattatacgaacccgtcctacgacggggtcccctaggtaaccctattccgtacgtcgggtcccttccgaagttcctacgggccctaacccttcgacggtccctaccccgtggcccaatccgaggttcgggcctcccgggtcgaggtactggggacggtcgttagtaatttaagttcgttggttgtttaggaagttggggacagcgaaggtccgttggacgttgtacctttagttcgttcgttacggaacgtcgggaacctacggtcttaccggtcgttaagggtaacccg

SEQ ID NO: 335690 - DNA, 728 bp, Homo sapiens
  misc_feature: GZ8MTXP01ANP72.2.49.E05.1.454.CMB.2.raw
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtcgtcgggtacccccggaggaggtcaccatctcttgtctaggaanctatcgtaccaaacagtacggaagtgaataatgtatacgtggtaccagcacgttcccaagcgcccgaccccaagcctcctacatcgtaataagaaattagtacgaaaccccggtcctacggtacggggtccctagaaacccgtatttcgtcgtacgggtccttacccgtaaagttccgtcgggaccctaacccgttcgaaccgtccccgtcccgtacggaccctagttaccgtacgggttccgggtcccgttacccggggtacccggaaagggtcgttagggggaacgggtccctttaggtaaaccttttaaagttaccgttgggttaggtttagggaagttacggggaaccctaagggcgaacggtcccgttagggtaccgttagttaccgtttaagttcggttaccgtttaccggaaacggttccggggaacccttaaccggggtcccttacccgggttccgttaacggggtaaccccg

SEQ ID NO: 335691 - DNA, 759 bp, Homo sapiens
  misc_feature: GZ8MTXP01AN6RF.2.49.E05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctnagcgtctcgggtacccccgggnaggaggtcaccatctnttgtctggaancatgtaccaanagtcggaagtgaatatgtatacgtggtacagctacgtaccaagacggcccgacccccaagtcctcctacatctaataagtaaattagtacgtaacccggtcctacggtacggggtccctaggtaacccgtatttccgtctcgggtacccttaccgtaaggttcctacgggtaccctacccgtcgaccgtccccgtccccgtagggccctaacgtcgacggggttcgggacccgttacccggggtacggtaacgggtagtacgggggtacggttaccgttaggtaacgtttttaaccgttacggttgggtttacgggtttaggggtacggttacgggggtaaacccaggggtacccgtaacgggtccgtttagggtaacggtttcggttaaccgttttaaggttccgggtttaccggttacccgggggtaacgggttccgggggtaacccttggggttacccggggttaccccttaaccccgggttccgttaacccgggg

SEQ ID NO: 335692 - DNA, 644 bp, Homo sapiens
  misc_feature: GZ8MTXP01DQWZ4.2.49.E05.1.454.CMB.2.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (563)..(563): a, c, t, g, unknown or other
  misc_feature (563)..(563): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagccgtcgtccgggtacccccgggaggacggtccaccattctcttgttcnggaancatgtccaanagtacggaagtgaataatgtaatacgtggtaccagcacgtcccaagcgcccggaccccaagtcctcctacatctaataagtaaattgtacggaacccggttccctacggaccgggggttcccctaggtaaacccgttatttccgtcgtcggtacccttaccgaagttcctggaccctacccgttcaccgtcccctacccgtggaccctaagtccgacgggttcgggcctcccggggtacgagggtatgggggaacgtcttaggtatttaagttcgttggttgttagggacgtgggacngcgaagtcgttgtagttgtcgtttagttcgttcgttacggaacgtcgggaaccctacgggtcttacccgtcgttcgaaccg

SEQ ID NO: 335693 - DNA, 575 bp, Homo sapiens
  misc_feature: GZ8MTXP01AL04D.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnagaggtcaccatctcttgtctggaagcatgtccaacagtcggaagtgataatgtatacgtggtaccagcagttacccaagacgccggacccccaagcctcctcatctaatacgaaattgacgaacccgtcctacgtacggggtccctagaaccgtattccgtcgtgcctacaagtctcggccacctcacgccctccgtgcccagttcaggtcgggccgttccgggtccgaggtacgtggggacggtcgtgtaactttagttacgtggttgttggagttcgggacaggccncgtcgttgngttgtcttagttcgttcgttacggaacgtcggcctacggtccttaccgtcgttcgtcg

SEQ ID NO: 335694 - DNA, 736 bp, Homo sapiens
  misc_feature: GZ8MTXP01B41OB.2.49.E05.1.454.CMB.2.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcgggtacccccggnaggaggtcaccatctcttgttctggaagcatgtaccaacatcggaagtgaataatgtaatacgtggtaccagcacgttacccaagagccggacccccaagcctcctcatactataagtaaattagtacgtaaccccggtcctacggtacggggtccctaggaaacccgtactttccgtcgtacgggtcctacccgtaagttccgtacgggaccctacccgttccgaaccgtccccgtcccgtcgggccctaaacgtccgacgggtcgggtcccgtcccggggttacccgagggtacgtcgggggaacggtcggttacgtaacgtttaagttaccgtttggttaggggtttaggggtaagttcgggggaacctacgggtcccgaaggtacccggttagggtacgttggtaaaccgtttcgttcgggttccggtttaccgggtaacggttccgggggtaaacccgttaccggggttacccgttaaccccggggttcccggttaacggggttaaccccgg

SEQ ID NO: 335695 - DNA, 768 bp, Homo sapiens
  misc_feature: GZ8MTXP01DKJVY.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggtaccccggnagaggtcacatctcttgttctggagctatcgtaccaacagtacggaaagtgaataatgtaatacgtggtaaccagctaacgttaccccgaaaggacggaccccggaccccccaaagtccctcctactaactacttaaataaagtaaaatttagtacggtaaaccccggtccctacggtaccggggtcccctacggaaacccgttactttcctcgtacggtccctacccgtaagtcgtcgggaccctaacccgttccgaccggtcccctccccgtacgggaccctaacgttccgtaacgggttccggggtcccgttccccgggggtaccggaaggggttaagtcgggggtaaacggttccgtttaaggttaatttttaaccgttaacgtttgggtttagggtttacgggtaaggttacgggggaacctacggccgtaaacgtcccggttaggtaacggtttcgttaccgtttaagttcggttaccgttacgggtaaacgtcgggaaccgtaccggtaccttacccggttaaccgttaacggtaaccccg

SEQ ID NO: 335696 - DNA, 699 bp, Homo sapiens
  misc_feature: GZ8MTXP01D3LNL.2.49.E05.1.454.CMB.2.raw
  modified_base (219)..(219): a, c, t, g, unknown or other
  misc_feature (219)..(219): n is a, c, g, or t
  modified_base (341)..(341): a, c, t, g, unknown or other
  misc_feature (341)..(341): n is a, c, g, or t
  modified_base (383)..(383): a, c, t, g, unknown or other
  misc_feature (383)..(383): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtctcggtaccccggnagaggtcaccatctcttgtctggaagcatcgtccaaacagtcggaagtgataatgtaatactggtaccagcagtaccccaagacgccgacccccaagcctcctcatctaataagtaaattancgaacccgtcctagacggggtccctagtaacccgtattcgtntggcctaccaagttcgtggaccctacccttacacgtcccctcccgtacggaccctaagttcccgaagggttccggggacccgtttccccggggtaccggtaaagggaccgttgggggaacggggtccttaagggttaaattttaagtttaaccgtggtttagggtttaccggaaaggttcgggggaaaccttgggacaacggtcccgtttgggaaacgtttggtcccttttaaagttcggtttccggtttaaccgggaaccgttcgggggaaccctacggggtacccttaaccggttccccgttaaggtaaccccg

SEQ ID NO: 335697 - DNA, 745 bp, Homo sapiens
  misc_feature: GZ8MTXP01BA1X3.2.49.E05.1.454.CMB.2.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtccgggtacccccgggnaggacggtcaccatcttcttgttcgtaggaacnctagtcgtaccaacgtacgtacggaagtagtaattaagtagtaactacgtacggtaccacgtaccgtaccggttacccgaacggaccggacccccggaccccacgtccttacctacgtacttaacgtaaattaagtaaattacgtaccggtaaccccggttccgtacggtaccgggtaccctacggtaaccgttcgttccgtacgtccgtaccctaccgtacgttccgtacgaccctacctccgacccgtccccgtaccgtcgtactacgtcggtacgggtccggccgtccggtacggaggtcgtacggggtacgtcgtagttacgtttacgtcggttggttggttagggtacggtacggaccgtcggtaccgtcgtcggttaggtacgttcgttacgttacggttccggtttccggttaaccggtaaccggtacccgggtaaccgtacccggttaccgttacccgttaaccgttaaccggtaaccg

SEQ ID NO: 335698 - DNA, 660 bp, Homo sapiens
  misc_feature: GZ8MTXP01AZ02V.2.49.E05.1.454.CMB.2.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (343)..(343): a, c, t, g, unknown or other
  misc_feature (343)..(343): n is a, c, g, or t
  modified_base (538)..(538): a, c, t, g, unknown or other
  misc_feature (538)..(538): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctnagcgtctcgggtacccccggnaggacggtcaccatctcttgttctggaagctatgtaccaacagtcggaagtgaataatgtatacgtgtaccagctacgttacccaagcgccggaccccaagtcctctcatctatagaaattntagaacccgtcctcgacggggtccctggaacccgtattccgtacgtggccctaccgaagtccgtcgggccctaccctcgtaccgccccttccccgtggaccctaacgtcgagggtcgggtcctccgggtaccgagggtacttggggaacggtctaggtactttagttacgtggttcggtttggaacgtggggacncggcaacggtccgttaggtcgttacgttaccgtttagttcgtttccggtttaacgggaaccggttaccgggggaacccttacgggtacccgttaccccgggttccgtttaaggtaaccccgg

SEQ ID NO: 335699 - DNA, 646 bp, Homo sapiens
  misc_feature: GZ8MTXP01BA170.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcaccatctcttgtctggaagcatgtccaacatcggaagtgataatgtatactggtaccagcagttcccaagacgcccggccccaagcctcctcatactataagaaattatacgaacccggttcctcgacggggtcccctaggaacccgtattcctcgtcgggcctccaagtctggcctacctcacgtccctccccgtggccctaatccgaggtcgggtcctcccgggtaccgagggacgttacggggacgggtccttggtaactttagttaccgtggttggtttagggagttggggaacctacggcgaacggtcccgttaggtagttcgtacgtttaacgttcggtttccgtttaccggggaaacgttcggggaaccccgtaccggttcccgttacccggttcccgttaacgggtaacccg

SEQ ID NO: 335700 - DNA, 600 bp, Homo sapiens
  misc_feature: GZ8MTXP01EJHJR.2.49.E05.1.454.CMB.2.raw
  modified_base (256)..(256): a, c, t, g, unknown or other
  misc_feature (256)..(256): n is a, c, g, or t
  modified_base (507)..(507): a, c, t, g, unknown or other
  misc_feature (507)..(507): n is a, c, g, or t
tcagacgctcgacacacgaccggtgctcgatttagagcgactagcaacacacaaaggggccccagccctgggattcccagctgtttctgcttgctgatcaggactgcacacagagaactcaccatggagtttgggctgagcttgggttttccttgttgcttaattttaaaaggtgtccagtgcgaggtgctgctggtggaggtccggggagcttagttcaggcccgggggtccctgagactctcctgtgcagcctntggattcaccttcagtcgctactggatgcacgtcggttcccgcctaagttccgaggggaagggctgggtaggtcgggtctacgacgctattgactccaatcgtagggaataggattaaccgcgcccgggacctccggtggaacggggccctaattccaaccatcctaccagacgaacaacgccaaggaaccacttctagtatacgtaggaaaatgaacggctaaggtctcgaagaggcgaaggacacggtnttacgtttatacgtgtacaactaaggttcgacggtcggttacggggattaaccgtgacctaacggtcggggccgagggtccttaaggttcggg

SEQ ID NO: 335701 - DNA, 666 bp, Homo sapiens
  misc_feature: GZ8MTXP01DY9HO.2.49.E05.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (591)..(591): a, c, t, g, unknown or other
  misc_feature (591)..(591): n is a, c, g, or t
tcagacgctcgacacacgaccggtgctcgatttagagcgactagcaacacacaaagggggggggaagctcagcttcagctgtggtagagaagacaggattcaggacaatctccagcatggccgcttccctctcctcctcaccctcctcactcactgtgcgagggtcctgggcccagtctgtgctgactcacgcccaccctnagccgtcgtccgggtacccccggnaggaggtcacctatcttcttgttcgtaggaagctatcgtaccaactagtacggaagtgaataagtgtaatacgtgtaccagctacgtacccgaagcgcccgaccccaagtcctcctacatactaagtaagtaaattacgtacggtaacccggtccgtacggtaccggggtccctacgaaacccgttatttccgtacgtcgggtaccctacgtaacgttcgtacggtaccctacccgttacgaccgtccccgtcccgtacggaccctaagtccggtagggtccgggacccgttcccgggtacggaggtacgtagggggtacggtgtttagttaatttacgttagttggttagttaggcgtagggacngctaagtcgttggtcgttgtactttgttcgttcgttacggaacgtacggcctacgtccaccgttcgcggtaaccc

SEQ ID NO: 335702 - DNA, 691 bp, Homo sapiens
  misc_feature: GZ8MTXP01E0SYJ.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctccaccctcctcactcactgtgcagggtcctgggcccagtctgtgctgactcacgccaccctcagcgtctcggtacccccgggnaggaggtcaccatctcttgttctggaagcatcgtaccaacagtacggaagtgaataagtgtatacgtggtaccagctacgtacccaagcgcccggacccccaagtcctccctacaacttactaattaaagtaaatttacgtacggtaaaccccggtcctacggacggggttcccctagaaacccgtatttccgtcgtcgggtaccctaccgtaacggttcgtcggaccctacccttccgaccgtcccctcccgtcggaccctaacgtccgtagggtccggggccgttcccgggtaccggaggtacgtcggggaggtcttagtactttagttacgtggttaggttagggagtcgggacgcggcgtaacgtccgttaggtacgttcgtacgttacgttcggttccgttaccgggtaaacggtcgggaacccgtaccggtaccgttacccggtaaccgttaacggtaacccg

SEQ ID NO: 335703 - DNA, 679 bp, Homo sapiens
  misc_feature: GZ8MTXP01BAY4U.2.49.E05.1.454.CMB.2.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (328)..(328): a, c, t, g, unknown or other
  misc_feature (328)..(328): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctnagcgtctcggtacccccggnagaggtcaccatctcttgtctggaanctatcgtaccaaacagtcggaatgaataatgtaatacgtggtaccagctacgttcccaagacgcccgacccccaagcctcctnatctaatagtaaattagtcgaacccggttcctgtacggggtccctaggaacccgatttctcgtcggcctaccgtagtcgtcggaccctaccctcaccgtcccctacccgtggccctagtccgtagggtccgggcccgttccgggtaccggagggtacgttggggaacggtcttaagtacgttttacgttacgttggttacggtttagggagtggggaaccacggtacaacggttccgttaggtacggtttcggttaccgtttagttcggttccgtttaccggggtaaccggttcgggaaccccgtacgggttacccgttaaccccggttcccgttaaccggggtaaacccc

SEQ ID NO: 335704 - DNA, 788 bp, Homo sapiens
  misc_feature: GZ8MTXP01AN9K6.2.49.E05.1.454.CMB.2.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtacccccggnagaggtcaccatctcttgtctggaancatgtccaacagtcggaagngataatgtatacgtggtaccagcacgttcccaagcgccggccccagcctcctnactctaatagtaaattagtcgaaccggttcctacggacgggggttcccctaggaacccgtatttccgtcgtcgggcccttacccgtaaacggttccgttacgggaccctaacccgtcgtaacccgtcccccgttaccccgtcgggtaccctaaaccgttccggacgggttccgggggtccccgttaccccggggtacccggaagggtacgtacgggggtacgggtacccgttagtaacgtttttaacgttacccgttggggttacggttttaggggacggttcggggaaacgtacgggtaccgtaacgggtccccgttaggggttacggttaccggttccggttttaaacggtttccgggtttaccccggtttacgggggtaaacccggttaccggggggtaaccccctaaccgggggttcccccgttaaaaccccgggtttcccggttaaacggggttaaccccccgg

SEQ ID NO: 335705 - DNA, 793 bp, Homo sapiens
  misc_feature: GZ8MTXP01BGOXE.2.49.E05.1.454.CMB.2.raw
  modified_base (223)..(223): a, c, t, g, unknown or other
  misc_feature (223)..(223): n is a, c, g, or t
  modified_base (635)..(635): a, c, t, g, unknown or other
  misc_feature (635)..(635): n is a, c, g, or t
tcagacgctcgacacacgaccggtgctcgatttagagcgactagcaacacacaaaggggggggaagctcagcttcagctgtggtagagaagacaggattcaggacaatctccagcatggccgcttccctctcctcctcaccctcctcactcactgtgcagggtcctgggcccagtctgtgctgactcacgcccaccctcagccgtcgtccgggtacccccggnaggacgggtccacctattccttctttgttcgtaggaagctatcgtaccaaactagtacggaagtgtaataagtagtaactacgtcggtaaccagtacctacgttaccccgaagtacggccccggacccccaagtcccttccctacattaccttaagtaaacgtaaaattcgtacggtaaccccggttccctacggtaccggggtcccctagaaacctacgttcttccgtcgtcggtacccttaccgaacgttccgtaccggaccctacccgtcgaccgtcccctcccgtacgggaccctagtcggtacgggttccggcccgttccgggtacgaaggtacggtggtacgggtcttaacgtttaagtttaacgttacgttgggtttaggttacgggtaacggttacgggaaccncgggtaaccgtaacggttccggtttaggttaacgtttcggtttaacccgttttaggttccgggttaacccggtttaaccgggggtaaaccgggttaacccgggtaaccccggtaccgggttacccccgttaacccggtttaaccgggtaaaccccggg

SEQ ID NO: 335706 - DNA, 645 bp, Homo sapiens
  misc_feature: GZ8MTXP01COKSV.2.49.E05.1.454.CMB.2.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagccgtctccgggtacccccgggnaggaggtcaccatctcttgtcnggancatgtccaacatacggaagngataatgtatatggtacagctacgttcccaagacgcccggacccccaagctcctcatctatagtaaattatagtaacccggtcctcggacggggtccctgaacccgtattctctggctacagtctaggccacctcacgtccctcccgtcggccctatcgaggtcgggccttcccgggtcgaggacgtggggaggtctagtacgtttaattccgtggttggttaggtgtcggggactaggaccgtaaggtcccgttaggtacggttggtacttttaagttccggtttacggttacccgggtaaacgggttccggggtaaccccgttaccgggggtcccgttaaccccgggttcccggttaacgggttaaccccggg

SEQ ID NO: 335707 - DNA, 662 bp, Homo sapiens
  misc_feature: GZ8MTXP01AJEHX.2.49.E05.1.454.CMB.2.raw
  modified_base (225)..(225): a, c, t, g, unknown or other
  misc_feature (225)..(225): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcacgcgtcgtcgggtacccccgggnaggacggtcaccatctcttgttctggaacgctatcgtaccaaacagtacggaagtagaataatgtaatactggtaccagactacgttacccaagacgcccgaccccaagtcctcctacactactataagtaaattacgtacgtaaccccggttcctacggtacgggggtccctacggaacccgttactttccgtcgtcggtcctaccgtaacgttcgcggccctaccctcgaccgtccctcccgtggaccctacgtcgtacgggtccgggtcccgttccggggtaccgagggtactggggacgtctagtactttagttacgtgtggttaggngtggacncgtcaaggtccttaggtagttcgttcgttaagttcgttcggttacggaaccggtcgggaaccgtaccgggcgttaacccgtccgttaacggtaacccg

SEQ ID NO: 335708 - DNA, 763 bp, Homo sapiens
  misc_feature: GZ8MTXP01B5RRT.2.49.E05.1.454.CMB.2.raw
  modified_base (277)..(277): a, c, t, g, unknown or other
  misc_feature (277)..(277): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagtcttgggttttccttgttgcttaattttaaaaggtgtccagtgcgaggtgctgcgtgggtggaggtccgggggagcttagttcaggccgtggggggtccctgacgactctcctgtgcagcctgtgacttcaccttnagtcgctactggatcgctacgttcggttccgaccgtaaacggttcccggaagggggtaacgggggtcgtagggggtaggttcgggggtcctccgacgtctaagttcggactcccgtagttacccggtaggggtaaacgttagggtaaactttaaacccggtaaaccgggtccccgggtcccggttaccgggtacgggggaaccgggggtaccccgtaactttacccggaaaccctaacgttcccgttaaccgaaacggaaacggaaccgaaacccggtacccgaaaacgggtaaaccctacgttaccgttaggttaactcggtaaaggaaacttgggggaacgtacgtaacgttccgagaagggacgggacggaacggaccgtacggtctttaggtttactaacgagacaacgttaggtacggacgggttcgggttcggggactaacgtacggaacgttacgggcgggaccgtgggcgtttaaggg

SEQ ID NO: 335709 - DNA, 760 bp, Homo sapiens
  misc_feature: GZ8MTXP01BP7LY.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggtaccccgggnaggaggtcaccatctcttgttctaggaagctatcgtaccaactagtcggaagtgaataagtgtatacgtcggtaccagctacgttaccgaagacgcccgaccccaagcctacctcattctaataacgtaaattgtacgaacccggtcctacggtaacggggtcccctacggaaacccgttatttccgtcgttacgggtaccttacccgtaagttccgtcgggaccctacccttcaaccggtcccctcccgtcggaccctacgtaccgaggttccggggcccgttcccgggtaccggaagggtaccgtagggggaacggtcgttaagttactttacgtttacgtggtttaggttagggtaaggttaggggaacctagggtcccgtaaacgggtcccggttaggtacggtttacgttaccggttttaaggtttcgggtttcccgtttaccggggaaacccgggttacccgggggtaaacccgttaccccggggttacccgttaacccccgggtttccccggttaaacggggtttaacccccg

SEQ ID NO: 335710 - DNA, 775 bp, Homo sapiens
  misc_feature: GZ8MTXP01COA1E.2.49.E05.1.454.CMB.2.raw
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtctcgggtacccccgggnaggagggtccacctatctcttgttctggagctagtcgtaccaanagtacggaagtgaataatgtatacgtggtaccagcacgttacccaaggacgccggacccccaagtcctcctacactctaataagtaaattagtacggtaaccccggtccgtacggtacgggggtccccctaggtaaacccgttactttcccgtcgttaccgggtcccttaccgaacgtcccgttcgggacccctaacccgttccaccgtccccgtcccgtcggtacccgtaacttccggtagggttccggggtcccgttccccggggtaccgggtaacgggtacgttcgggggaacggttccgttggttaaacgttttagtttaccggttcggtttggttaggggtacgttacgggggactagggtccgtaacggtccgttaggtccggttagttacccgttttaggtttccgggttaccgtttacggggtaacccgggttcccggggtaacccggtaccggggttaccccgttacccgggtttaacccggttaaccgggttaaccccg

SEQ ID NO: 335711 - DNA, 793 bp, Homo sapiens
  misc_feature: GZ8MTXP01A4M91.2.49.E05.1.454.CMB.2.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagccgtctcggtacccccgggnagaggtcaccatctcttgtctggaagcatcgtaccaacagtacggaagtgaataatgtaatacgtaggtaccagcctagttccccaaagacggcccggacccccaagcctcctacatctaataagtaaattagtacgtaaaccccggttcctacgtacgggggtcccctacggtaacccgttaactttcctccgtacgggtcccttacccgtaacggttccgtacgggtccctaaccccgttccgacccgtcccccgttccccgtcgggaccctaacgtccgtaacgggttccggggtcccgtaccccgggttccgggaagggtaacgttcgggggaacgggttcttaaggttaacgtttaacgtttaacggttgggttaggggtttacgggaagggttaccgggggttaacgtaacgggtcccgaacgggtcccggttaggtacgggtttcgttaaaccgttttacgttccgggtttaccgggttacccggggtaaaccggttacccgggggaacccgttaacccggggttccccttaaaccccgggttccccgttaacggggtaaccccgg

SEQ ID NO: 335712 - DNA, 609 bp, Homo sapiens
  misc_feature: GZ8MTXP01BQ8R6.2.49.E05.1.454.CMB.2.raw
  modified_base (219)..(219): a, c, t, g, unknown or other
  misc_feature (219)..(219): n is a, c, g, or t
  modified_base (332)..(332): a, c, t, g, unknown or other
  misc_feature (332)..(332): n is a, c, g, or t
  modified_base (460)..(460): a, c, t, g, unknown or other
  misc_feature (460)..(460): n is a, c, g, or t
  modified_base (588)..(588): a, c, t, g, unknown or other
  misc_feature (588)..(588): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcaccatctcttgtctggaagcatgtaccaacatacggaagtgataatgtatactggtaccagcagttcccaagacgccggccccaagctcctcatctatagaaattntagaaccccgtcctcgacggggtccctagaacccgtattcgctcgggcctccaagtcctggcccacccttcacggccctcccgtcggccacttccgaggtcgggcccgtcccgggtacggaggtacgnggggaacgggtcctaggttatttaacgttcgtggttaggttggtacgtggggacaggtcgaacgtccgttggtacgttgtacttagttcggttcgttacgggaagttccggggaacctcgggttaccnccggttccgttaacggtcccg

SEQ ID NO: 335713 - DNA, 726 bp, Homo sapiens
  misc_feature: GZ8MTXP01DXIVA.2.49.E05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctnagccgtctcgggtacccccggnagacgggtcaccatctcttgttcnggaagcatgtaccaanagtacggaagtgataattgtaatacgtggtaccagctagttacccaagacgcccggacccccaaagtcctcctctatactaataagtaaattagtacgtaaccggtcctacggtacggggtccctacggaacccgtatttcctcgtcgggtcccttaccgaacgtcgtcggaccctaccctcgaccgtccctcccgttggccctaactccggtacggtcggggtcccttacccggggtaccggaagggtacgtgggggtaacgggttcttaggttaatttacgttacggttgggtttaggttagggtagttacggggacacgggtctaacggttccgttaggttacggttaggttcttttaacggttcggttttccgtttaacccgggggaacggtttacccgggggaacccctttaaccgggggtcccttaaccccgggttttccgttaacggggttaaccccg

SEQ ID NO: 335714 - DNA, 766 bp, Homo sapiens
  misc_feature: GZ8MTXP01EGLYU.2.49.E05.1.454.CMB.2.raw
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacaaagggggggaagctcagcttcagctgtggtagagaagacaggattcaggacaatctccagcatggccgcttcctctcctcctcaccctcctcactcactgtgcagggtcctgggcccagtctgtgctgactcagccaccctcagcgtctcgtaccccccgggnaggaggtccactatctcttgtcgagganctatcgtaccaactagtacggaagtagtaataagttagtaatacgtacggtaccagtctaacgtacccgaaggacgccccggaccccaagtcctacctactaatactaagtaaagtaaattagtacgtaaccccgtccgtacggtacgggtccctacgtaacccgtattccgtcgtcggtaccttaccgtaacgttccgtacggtaccctacccgtaccgaccgtcccgtacccgtcggaccctacgttaccggtacgggttccggggcccgttacccggggtaccggaagggttacgttacgggggtaacggtaccgttaagtttaacttttaacgtttacggttgggtttacgggtttagggtaacggtacggggtacgtaacggacgtaaccggtccgttagggttaacggttcgttaacgtttacggttcggttcccggtttaacgggaaccgggttaccgggtaacccgttaaccgggttacccgttacccgggttaaccggttaacgggtaacccg

SEQ ID NO: 335715 - DNA, 633 bp, Homo sapiens
  misc_feature: GZ8MTXP01DM32J.2.49.E05.1.454.CMB.2.raw
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (333)..(333): a, c, t, g, unknown or other
  misc_feature (333)..(333): n is a, c, g, or t
  modified_base (387)..(387): a, c, t, g, unknown or other
  misc_feature (387)..(387): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcgagggtcctgggcccagtctgtgctgactcacgcccaccctcagccgtctcgggtacccccggnaggaggtccacntctnttgtcnggaancatcgtaccaanagtcggaagtgaataatgtatacgtggtaccagcacgttacccgaagcgcccggacccccaagcctcctanatctaatagaaattgtacgaacccgtcctacgacggggtccctaggaacccgtntttccgtcgtcggtcctaccgaacgttctcgggaccctaacccttcgaccgtccccttcccgtgggccctaagtccgtagggttcgggcccgtccgggtaccggaggtacgtggggacggtcgtagttaatttagttacgtgttggttaggagtgggacagcgaagtcgagtacgttcgtactttagcgtttcgttacggtaacggtacggaaccctcggtccttaccgttccgaaggtaaccccg

SEQ ID NO: 335716 - DNA, 677 bp, Homo sapiens
  misc_feature: GZ8MTXP01CUV17.2.49.E05.1.454.CMB.2.raw
  modified_base (251)..(251): a, c, t, g, unknown or other
  misc_feature (251)..(251): n is a, c, g, or t
tcagacgctcgacacacgaccggtgctcgatttagagcgactagcaacacacaaaggggccccagccctgggattcccagctgtttctgcttgctgatcaggactgcacacagagaactcaccatggagtttgggctgagtcttgggttttccttgttgcttattttaaaaggtgtccagtgcgaggtgctgcgtggtggaggtccggggagtcttagtcgaggccgtgggggtccctgagactctcctgngcagcctcgtggacttccaccgttcagtcgctacgtggatgccgtacgttccggttaccgccgtaaggttcccggaagggggaacgggggtcgtaggggacggttcggggtctaccgacgctagttgacttccgtagttccgtaggggtaatagggtaacttaaccgaacggccggtcccgtcggtgggacggggtcctacttaccgactactacctaccgaaggaacgaacgaaccgacccgaagtaaccacgtaccgtagttactcgtaaggtaaattcggggaacgtcgagttacacgaaaggcggacgaacgggactacgggtacttagtttaacgtctagttacacgaggttcgggacgttcggggttacgggagtccgtacggtaacgttccgggacgggaccgaagggttcgttaacgg

SEQ ID NO: 335717 - DNA, 577 bp, Homo sapiens
  misc_feature: GZ8MTXP01DA3R7.2.49.E05.1.454.CMB.2.raw
  modified_base (485)..(485): a, c, t, g, unknown or other
  misc_feature (485)..(485): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (570)..(570): a, c, t, g, unknown or other
  misc_feature (570)..(570): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagcttgggttttccttgttgcttaattttaaaaggtgtccagtgcgaggtgctgctgggtggaggtccggggggaggtcttagttcaggccgtggggggtccctgacgactctctgtgcagcctctggattccacttcagtcgctacgtggatcgctactcggttccgaccgaaagttccggaaggggaagggggcgtgggaggtggggtcctcgacgctattcgactcagtaccgtagggaaataggtaacttaaccgtaaccggtcggtcccgtcgggtagggacggggtcctattaccgaccatcctacgagaacgaacaaccggacgaagacactctagtancgtaagaatggagcaagtcagaggngcgaagctgtctnttatnganacgagtcgcgttgggttggatcgagcgtacggcgggacngggctgg

SEQ ID NO: 335718 - DNA, 689 bp, Homo sapiens
  misc_feature: GZ8MTXP01AOCJT.2.49.E05.1.454.CMB.2.raw
  modified_base (220)..(220): a, c, t, g, unknown or other
  misc_feature (220)..(220): n is a, c, g, or t
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagccgtctcggtacccccggnagaggtcaccatctcttgttctaggaagcatcgtaccaacntcggaagtgaatatgtatactgtaccagcagttccaagcgccgccccaagcctcncatctatagaattangaaccgtcctcgacgggtccctgaaccgtattcncgtgcctaccgtaagtccgacgtccaccttcgacgtcccctcccgtcggaccctagtccgtacgggtcggggtccccgttcccggggtaccgtaagggtaacttcgggggaacgggttccttaagggttaacttttaagtttaccggttggttacgggtttacggggagttaccgggggaacgtacggtcgaacgggtccgttagggtacggtttcggtaaccgttttagttcgggtttacccggtttacgggtaaacccggttcgggggaaaccccgttaccggggttaccgttaccccggttcccggttaacggtaaccccg

SEQ ID NO: 335719 - DNA, 684 bp, Homo sapiens
  misc_feature: GZ8MTXP01BUQ7N.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnagaggtcaccatctcttgttctggaagcatcgtaccaacagtcggaagtgataatgtatacgtggtaccagctacgttacccgaagcgccggacccccaagcctcctacactactaataacgtaaattagtacggaaaccccggttcctacggtaccgggggtcccctacggaaacccgttactttccgtcgttacgggtcccttacccgtaaacggttccgtcgggtaccctaccccttcgaaccgtccccgttcccgtacggaccctaacgtccgaagggtcggggacccttcccgggtaccgagggtacgtacgggggacggtcgttagtaagtttacgttacgttggttggttagggtagtacgggggtacacggtcgaacggtccgttaggtacgttgtacttagttcgttcgttacggaacgtcgggaaccgtcggtaccaccgttccgaaggtaacccg

SEQ ID NO: 335720 - DNA, 727 bp, Homo sapiens
  misc_feature: GZ8MTXP01E34X4.2.49.E05.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcacgccacccctnacgcgtcgtccgggtacccccggnagagggtccaccatctcttgtctgagcatgtaccaanagtcggaagtgaataatagtatacgtaggtacagcacgtacccaagcgaccggaccccagtcctcctactactactaagtaagtaaaattacgtacggtaaaccccggttcccgtacggtaccgggggttacccctcggtaaacccgtctttcccgtacgtccgggacctacccgtaacgttcgtcggacccacccgttcgaccgtcccctcccgtcggtcctaacgtcggtacgggtccgggtaccgttcccgggtaccggaggtacgtaggggtaacggtcgttaggttaactttaagttccgttggttaggggttagtagggtacccggggaacacggacgtaacggtacgttaggtacgttcgttaacgtttcgttaccggttacccggttaccggggtaacccggtacgggtaacccgtccgggtacccgttacccgggttccgttaacccgggaacccg

SEQ ID NO: 335721 - DNA, 754 bp, Homo sapiens
  misc_feature: GZ8MTXP01BGEU3.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtcgtcggtacccccgggnaggacggtcacctatctcttgttctggaagctatgtaccaactagtacggaagtgaataatgtatactggtaccagctacgttacccaaggacgccccggacccccaagtcctcctacattactaataagtaaatttagacggtaacccggtcctacggacggggttcccctaggaaaccccttagtttcctcgtcgggtacccttaccgtaaggtttccgtacgggtccctaacccgttccgaccgtcccccttacccggttcgggccctaagtccgtacgggtccggggtaccgttccccggggtacgacgggtacgtcgggggaacggtcgttaggttactttaaacgtttcggttggttagggttagggtaagttcgggggaactacggccgtaacgggtccgttagggtaggttcgtaccgttttaaggttccggtttaccggttaccggggtaaaaccgggtccggggtaaccccggttaccggggtaccccgttaccccgggttcccgttaacggggtaacccccg

SEQ ID NO: 335722 - DNA, 720 bp, Homo sapiens
  misc_feature: GZ8MTXP01COC8T.2.49.E05.1.454.CMB.2.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (395)..(395): a, c, t, g, unknown or other
  misc_feature (395)..(395): n is a, c, g, or t
  modified_base (438)..(438): a, c, t, g, unknown or other
  misc_feature (438)..(438): n is a, c, g, or t
tcagacgctcgacacacgaccggtgctcgatttagagcgactagcaacacacaaaggggggggaagctcagcttcagctgtggtagagaagacaggattcaggacaatctccagcatggcccggcttccctctcctcctcaccctcctcactcactgtgcagggtcctgggcccagtctgtgctgactcacgcccaccctgagcgtcgtcgggtacccccggnaggcggtcacctatcttcttgtcaggaagctatcgtccaaanagtcggaagtgaataagtgtatacgtggtaaccagcacgtccaaggcgcccgacccccagcctcctcaatcgtaataagtaaattgacgtaaccccggtctacggacggggttccccagtaaacccgttnttcccgtgtcgggaccttaccgaagttcgacggtcccaccctnacccggtcccctcccgttcgggaccctagtaccgtcgggttcgggcccgttacccgggtaccggagggtacgtacgggggacggttaccgtttgttaaagttttacgttccggttagggttaggtttaccggggaggttacggggaacctacgggtccgcgttacccggttggtaaaggttccgttaaacgtttcgttaggttcccggtttacgggaaaccgttcgggggtaaacccgtccgggtaacccgttaccccggttccggttaacggtaaccccgg

SEQ ID NO: 335723 - DNA, 697 bp, Homo sapiens
  misc_feature: GZ8MTXP01DOW36.2.49.E05.1.454.CMB.2.raw
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggtacccccgggaggaggtcaccnttctnttgttcnggaanctatgtaccaanagtacggaagtgaattaagtgtatacgtcggtaccagctacgtacccaaggacgccccggacccccaagtcccttacctctaataccttaaagtaaacgtaaattagtaccggtaacccggttccctacggtacgggggtccccttcggaaacccgttactttccgtacgtcgggacccttaccgaacggttcgtacggaccctaccctcgtaccgtccctcccgtaggaccctagtcggagggtccgggccgtccgtcggaggtctcggggaggtcttagtactttacgttgtggttagttacggaagttcgggaactcgcgtaacgtcttaggtaacgttcttaaacgtttgttcggtttccgttaaccgggaaccggttaccgggtaacccgtcgggtaccccgttacccgttaaccgttaacggtaaccccg

SEQ ID NO: 335724 - DNA, 712 bp, Homo sapiens
  misc_feature: GZ8MTXP01BDE86.2.49.E05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagacgctcgacacacgaccggtgctcgatttagagcgactagcaacacacaaaggggggggaagctcagcttcagctgtggtagagaagacaggattcaggacaatctccagcagtggccggcttccctctcctcctcaccctcctcactcactgtgcagggtcctgggcccagtctgtgctgactcagccaccctnagcgtctcgggtacccccgggnaggacggtccactatcttgttgtcgtaggaanctagtcgtaccaatagtacggaagtagtaataagtagtatacgtacggtaccagacgtacgtacccgaagaccggaccccggaccccaagtcctacctactacttactaataaagtaaacttacgtacggtaaccccggtcctacggtaccgggtccctacggtaaaccgttacttcgtcgtcggtacctaccgtaacgtcgtacgaccctacccgtacaccgtcccgtacccgtcggacctacgtacggtacgggtccgggccgttacccgggtacggtaagggtacgtcgggggtacggtcgttagttaacgtttaacgttacgttgggttacggttagggtacggtacgggaactcggtcgtaacggtcgttaggtacgttcgtacttacggttcggttccgttaccgggaacggtccgggaaccgtaccggtccgttacccgtcgttaacggccg

SEQ ID NO: 335725 - DNA, 723 bp, Homo sapiens
  misc_feature: GZ8MTXP01DLZ48.2.49.E05.1.454.CMB.2.raw
  modified_base (226)..(226): a, c, t, g, unknown or other
  misc_feature (226)..(226): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtccgggtaccccccgggnaggagggtccaccattctcttgttctggaagctatcgtaccaaacatacggaagtgataatgtaatacgtgtaccagcacgttcccaagacgccgacccccaagcctcctcatactataacgtaaattatacggtaacccggtcctacggtacggggtcccctagaacccgtatttcgtcgtcgggcctaccgtaaacgtctcgggaccctacccgttcacgtcccctcccgtcggaccctaagttccgtaacgggtcggggtcccgttcccgggtacccgggaagggtacgtacgggggacgggtcgtttaaggttaagttttaacgtttaaccgttggggtttaggtttacggggtaaggttggggaacctacggccgtaacggtcccgttaggtaagggttcgtacgttttaagttccgggttcgtttaccggggtaaccggtacggggtaacccgtccggtaccttacccggttccgttaacgggtaaccccg

SEQ ID NO: 335726 - DNA, 693 bp, Homo sapiens
  misc_feature: GZ8MTXP01CSEFN.2.49.E05.1.454.CMB.2.raw
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (525)..(525): a, c, t, g, unknown or other
  misc_feature (525)..(525): n is a, c, g, or t
  modified_base (557)..(557): a, c, t, g, unknown or other
  misc_feature (557)..(557): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctnagcgtctcgggtacccccggnaggagggtcacctatctcttgttcnggaagctatcgtccaaanagtacggaagtgataatgtaatacgtggtaaccagcaacgttacccgaaggacgcccggacccccaagcctcctacatactaataagtaaaattgtacggtaaaccccggtcctacggacggggttcccctaggaacccgttaatttccgtcgtcgggaccctacctaagtctcggacctaccctcacgtccccgtcccgtacgggacctagtcggtacggtcgggcccttaccgggtccgaaggacgttgggggaacggtnttaagtatttaagttacgttggtgttaagggngttagggacacggctaacgtacgttggtaaggccttacgtttagttacggtttcccgttaaaccggggtaaccggtccggggtaaccccgtacgggtaccccgttaaccccggttaaccgttaacgggtaaccccg

SEQ ID NO: 335727 - DNA, 676 bp, Homo sapiens
  misc_feature: GZ8MTXP01DZI5I.2.49.E05.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcaggtcctgggcccagtctgtgctgactcacgccaccctcagcgtctcggtacccccggnagaggtcaccatctnttgtcnggaancatcgtacaacagtacggaagtgataatgtaatactggtaccagcacgttaccccaagacgcccggacccccaagtcctacctctaatcttaagtaagtaaattatacggtaacccggtccgtacgacgggggttcccctcggtaacccgtatttccgtcgtcgggtacctacccgtaaggttccgtcgggaccctaccctcgtaccggtcccctccgtcgggaccctaagtcgtacggtcggggtcctcccggggtacggaaggtacgtggggaacggtcgttagtaagtttacgttacgttggttggttacgggagttcggggactaggcaaggtcgttaggacgttggtacttttagttcggtttcgttaaccgggaacggtccgggtaacctacggtccttaaccccggttcgttaacggtaaccccg

SEQ ID NO: 335728 - DNA, 671 bp, Homo sapiens
  misc_feature: GZ8MTXP01BLFCK.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtaccccccgggnaggacggtccacctattcttcttgttcgtaggaacgctatcgtaccaactagtacggtaagtagaataagtagtaatacgtacggtaccagactacgtacccgaacggacggaccccggacccccaacgtccctacctactacttactaaataaagtaaattagtacggtaaccccggttccgtacggtaccggggtccctacgaacccgtacttccgtcgtcgtcctaccgtagtcgtcgacctacctcaccgtccctcccgtcgtcctacgtcgtacggtcgggccgtccgggtacggaggtagtggggacggtcgtagtagtttagttacgtggttggtaggtagtcgggacacggcgaacggtcgttaggtgttcgtacgttagttcggttccgttacgggtaacgtacgggaaccgtcggtccgaccgttcgttaacggtaaccg

SEQ ID NO: 335729 - DNA, 653 bp, Homo sapiens
  misc_feature: GZ8MTXP01AGJ9K.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccgcttccctctcctcctccaccctcctcactcactgtgcagggtcctgggcccagtctgtgctgactcacgcccaccctcacgcgtcgtccgggtacccccggaggacggtccacctatcttcgttgttctagggaacgctatcgtaccaacgagtacggaagtgaatatgtatacgtggtaccagcacgtccgaagcgcccgccccaagtcctctcatctaataagaaattcgacgtacccgtcctacggaccggggtccctagaacccgttattccgcgtcggtactaccgtagttcgcgaccaccctcacgtcccctccgagccctaacgttcgacgggtccgggtcccgtaccgggtcggtaaggtacgtacggggaaccggtgtttagtaacgttttaaccgttgtggtttgggttaggaccggtgggaactacggccgtaagtccgttaggtcgttcgttacttacggttcgttacgttaccgggaacgtcgggaaccctggtcccgaccgttcgttaagaaccccg

SEQ ID NO: 335730 - DNA, 699 bp, Homo sapiens
  misc_feature: GZ8MTXP01D39TW.2.49.E05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (596)..(596): a, c, t, g, unknown or other
  misc_feature (596)..(596): n is a, c, g, or t
tcagacgctcgacacacgaccggtgctcgatttagagcgactagcaacacacgaaagggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtcgtcggtacccccgggnaggacggtcacctnttcttcgttgttcgtaggaanctagtcgtaccaacagtacggaagtagtaataatagtaacttacgtacggtaaccacgtactaacgtacccgaaggaccggccccggaccccaagtcctacctactaactactaagttaaagtaaattacgtacggtaacccggttcccgtacgggtaccggggtccctacggtaacccgttactttccgtcgtaccgtaccctaccgtaacgtcgtcgccctacctccgaccgtcccgtccgtcgacctacgtcggtacggtcgggccggtaccgggtacggaaggtgtacgggggacgtgttagttattagttcgtggttaggtaggaggtgggacncggcgtaacgtcgttgggtacgttcgttacgtttgttcggttccggttacggtaacggtccgggtaacccgtacggtccgttaccgttccgttaacggtaacg

SEQ ID NO: 335731 - DNA, 702 bp, Homo sapiens
  misc_feature: GZ8MTXP01D53AY.2.49.E05.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcacgcccacccctnagccgtcgtccgggtaccccccgggnaggacgggtccacctattcttcttgttcgtggaancatcgtaccaacagtacggaagtgaataatgtaatacgtggtaccagcacgtacccaagacgccccggacccccaagtcctcctactaatctaataagtaaattagtacggtaaccccggtccgtacgtaccggggtccctacggtaacccttatttccgtcgtcgggtacccttaccgaagttcgtacggccctaccctcgaccgtccctcccgtcggacctacgtcggtagggtccggggtacctcccggggtacgagggtacgttcggggaacggttcttagttaattttacgttaacgttgggttggttaggtaggttacgggacaggtccaacggtccgttaggtcgttcgttacgtttaagttccggttacgttaccgggaacgttccgggaacccttccgggtaccgttacccgtcgttaacggtaaccccg

SEQ ID NO: 335732 - DNA, 672 bp, Homo sapiens
  misc_feature: GZ8MTXP01BJDE1.2.49.E05.1.454.CMB.2.raw
  modified_base (219)..(219): a, c, t, g, unknown or other
  misc_feature (219)..(219): n is a, c, g, or t
  modified_base (600)..(600): a, c, t, g, unknown or other
  misc_feature (600)..(600): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggtaccccggnagagggtcaccatctcttgttctggaagcatcgtaccaaacgagtacggaagtgataattgtatacgtcggtaccagacctacgtaccaaggacgccccggacccccaagtcctccctactacttactaattaaagtaaattagtacgtaaccccggttcctacggtaccggggtccctacgtaacccgttacttccgtcgtcggtacctacccgaacgttcgacggtccctaacccgtcaccggtccccttccccgtcggacctaacgttccgacgggttcgggccgttacccgggtacgagggtacgtggggacggttgttacgtatttaacgttgtggtttcggttaggagtcgggactgccgtaagtcgttggtagngtttactagttcggttaccgttacggtaacggccgtaaccgtccggtccacccgggttaacttcggtaaccg

SEQ ID NO: 335733 - DNA, 764 bp, Homo sapiens
  misc_feature: GZ8MTXP01DPNUA.2.49.E05.1.454.CMB.2.raw
  modified_base (68)..(68): a, c, t, g, unknown or other
  misc_feature (68)..(68): n is a, c, g, or t
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
tcagacgctcgacacacgaccggtgctcgatttagagcgactagcaacacacgaaagggggggggaanctcagcttcagctgtggtagagaagacaggattcaggacaatctccagcatggccgcttccctctcctcctcaccctcctcactcactgtgcgagggtcctgggcccagtctgtgctgactcacgcccacctnagtccgtcgtccggtaccccggnaggtacggtccacctattcttcttgttcgaggaagctatcgtaccaagtagtacggaagtgaacttaatgtaactacgtacggtaaccacgtcgtaacggttaccccgaaggccggaccccgaccccctaagtcccttaccctacgtaacttacttaaagttaaagtaaacttacgtaccggtaacccccggttccgtacgggtaccgggggttacccctacggtaaacccgttactttccgtacggttcggtaccctaccgtacggtccgtacgaccctacctccgaccgtccccgtccgtcggacctaacgtccggtagggtccgggacccgttaccgggtacggaggtacgtggggacggttacttagttacgtttagtcggttggttagggtacggtaggtcgggactacggcgtcgttcggttggttacgttcggttacgtttacgttcgggtttacggttccggggtaaacgggttcccgggtaacccgttacccgggttaccgttacccggttccggttaaccggtaaccccg

SEQ ID NO: 335734 - DNA, 867 bp, Homo sapiens
  misc_feature: GZ8MTXP01AL8DX.2.49.E05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctnacgcgtcgtcggtacccccggnaggaggtccacctatcttcgttgttcgtagggaaacgtctagtcgtacccaaacgtagtacggaaagtgtaaattaacttggttaacttaaccgttacggtaaccgacgtaccgtaaaccggtttaccccgaaaggaccggcccccgggaaccccctaaaggtccccttaccttactaactttaccttaaagttaaacgtaaaatttaacgttacggtaaccccggttcccgtacggtaaccggggttcccctaggtaaacccgttacgtttccgtacgtccggtaccttacccgtaacgttccgtacgggtacccctaccgttccgaacccggtccccgttaccccgtcgggtacccctaacggttccgtaaccgggggttccgggggtaccccgttaccccgggggtaacccggtaagggtaacggttacgggggtaacgggttaccgtttagttaaaccgtttttaacggtttaaccgttgggtttagggttaaccggggtagggttaccggggaaacccggtacggtaccgtaacggtcgttaggttacgttcgttacgtttacggttcggttaccggttaaccggtaaccggtcggtaacccgttcggtaccgttaccggtaaccgttaaccggtaaccg

SEQ ID NO: 335735 - DNA, 585 bp, Homo sapiens
  misc_feature: GZ8MTXP01ECGPL.2.49.E05.1.454.CMB.2.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagacgctcgacacacgaccggtgctcgatttagagcgactagcaacacacaaaggggggaagctcagcttcagctgtggtagagaagacaggattcaggacaatctccagcatggcccggcttccctctcctcctcaccctcctcactcactgtgcagggtcctgggcccagtctgtgctgactcagccaccctnagctctggtacccccgggagaggtcacatctcttgtcaggaancatcgtaccaanagtacggaagtgaataatgtaatacgtgtaaccagtctacgtaccaagcgcccgaccccaagtcctctacatcgtaataataaattgtacgtaaccgtcctacggacggtccctacgaaaccgttatctcgtcgacctaccgtaagtcgngaccacctcgacncctccgtcgacactacgtacgtcggcgtccgtaccgacgacgaggagcgtacgtagtactacgtgtgtgtgtagacgacgcgaacgtcgagtagttagtagttattacgttcgttacgtaacggtacggtaaccggtaccgtaccgttaccgtaaccgttaaccgtaacg

SEQ ID NO: 335736 - DNA, 778 bp, Homo sapiens
  misc_feature: GZ8MTXP01D1ULQ.2.49.E05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
tcagacgctcgacacacgaccggtgctcgatttagagcgactagcaacacacgaaagggggggggaagctcagcttcagctgtggtagagaagacaggattcaggacaatctccagcatggccgcttccctctcctcctccaccctcctcactcactgtgcagggtcctgggcccagtctgtgctgactcacgccaccctnagcgtcgtccgggtaccccggnaggtacggtcaccattctcttgtctggaancatcgtaccaanagtacggaagtgaataagtgtactacgtacggtaccagtacacgttacccgaagacgcccgacccccaagtccctctactatactataataaatagtacgtaaccccgtcctacgacggggtccctaggtaaccctattccgtcgtcgggacctacccgtaagttccgtacggccctacccgtccgtaaccgtccccgttacccgtacgggacccctaacgttaccggtacgggtccggggtccccgtaccccgggggttacggaacgggtacggttaacgggggaaccggggttactttaaggtttaaacgttttacgtttaacccggttggggttttacgggtttaggggtacggttaacggggacaaccgggtctaaccgggttccgttaagggtacggttggttaccgtttttacggttcggtttaccgggttacccgggaacgggttccgggtaaccccggtaccgggtacccgttacccggggttaaccgttaaccggtaaccccgg

SEQ ID NO: 335737 - DNA, 794 bp, Homo sapiens
  misc_feature: GZ8MTXP01EZIHH.2.49.E05.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccacccctgacgccgtcctccgggtaccccccgggnaggaggtccacctatcctnttgttcnggaacnctatcgtaccaactagtacggaagtgaataatgtaatacgtgtaccagactacgtacccgaagaccggtcccgacccccaagtcctacctaccaagttacctaaagtaacgtaaattacgtacggtaaccccgttcccgtacggtaaccgggggttcccctacgaaaacccgttattcccgttcgtacgggaccttacccgtaaacgttccgtacgggtccctaaccccgtcgtaaccccgtcccgttcccccgtagggacccctaacgtccgtacggggtccgggtcccgttcccggggtaccgaaggggtaaccttggggggaacggttaccgtttaggttaaacttttaccgtttaacggttggttagggttacgggtacgttagggggaaccagggttccgaaacggtccgtttaagggtaaccgtttgtaacgtttacgttcccgggttacggtttaacccggaaacgggtcccgggtaacccgttaacgggtccccttaaccgggtaaccccggttaaggtaacccccg

SEQ ID NO: 335738 - DNA, 737 bp, Homo sapiens
  misc_feature: GZ8MTXP01EOADJ.2.49.E05.1.454.CMB.2.raw
  modified_base (226)..(226): a, c, t, g, unknown or other
  misc_feature (226)..(226): n is a, c, g, or t
  modified_base (367)..(367): a, c, t, g, unknown or other
  misc_feature (367)..(367): n is a, c, g, or t
tcagacgctcgacacacgaccggtgctcgatttagagcgactagcaacacacgaaagggggggggaagctcagcttcagctgtggtagagaagacaggattcaggacaatctccagcatggccggcttccctctcctcctcaccctcctcactcactgtgcgagggtcctgggcccagtctgtgctgactcagtccaccctcagtccgtcgtccggtacccccggnaggcggtccacctatcttcgttgttcgtagggaacgtctagtcgtaccaaacacgtacggaagtgtaataattagtaatacgttcggtaaccacgacgtacgttacccgaagaccggccccgacccccaagtcccctaccnctatacgtaattaagtaaacttagtacgaacccggttccgtacggtacgggtccctacgaacccgttattccgtactcgggcctaccgtaacggtcgtcggaccctaccctcgaccgtcccgtacgtccgccgtacgtcgtacgggtcggtccgtcccgggtacggaaggtcgtacgggacggttacgttaggttaattttaacgttcggtgggttttaggtaggggttaggaccgggtagacggtccgtcggtccttaggtacgggtttcttcgttttaacggttcggttttccgggttaacggttaacggggtcccggtaacccggttaaccggtcccgttaacccggtccgtttaacggaaccccgg

SEQ ID NO: 335739 - DNA, 753 bp, Homo sapiens
  misc_feature: GZ8MTXP01DCBGT.2.49.E05.1.454.CMB.2.raw
  modified_base (248)..(248): a, c, t, g, unknown or other
  misc_feature (248)..(248): n is a, c, g, or t
tcagacgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgacctcacgcccaccctcagcgtctcgggtacccccggagacggtcacatctcttgtctggaancatcgtaccaagagtacggaagtgaataagtgtaactacgtcggtaacccagctaacgttaccccgaaagacgaccccggacccccaagccctacctactaatacttaaataagtaaaatttacgtaccggtaaaccccggttcccgtacggtaccgggggttcccctacggtaacccgttaactttcccgttacgtacgggtacccttaccgtaacgttccgtaccggaccctacccttccgaccgtcccctcccgtcggaccctaggtccgtagggttccggggcccgttacccggggaccgaagggtacgtacgggggacggttccgttagttaagttttaacgttcgttggtttgggtttaagggacggttcgggaaccacgggtcgtaacggtccgttagtacggttcttacgtttaagttcggttacggttaacccgggtaaggtccgggtaacccgtacggttacccgttaccggttaaccgttaacgggtaaccccg

SEQ ID NO: 335740 - DNA, 762 bp, Homo sapiens
  misc_feature: GZ8MTXP01AUNU4.2.49.E05.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (674)..(674): a, c, t, g, unknown or other
  misc_feature (674)..(674): n is a, c, g, or t
tcagacgctcgacacacgaccggtgctcgatttagagcgactagcaacacacgaaagggggggaagctcagcttcagctgtggtagagaagacaggattcaggacaatctccagcatggcccggcttccctctcctcctcaccctcctcactcactgtgcgagggtcctgggcccagtctgtgctgactcacgcccaccctnagccgttcttcggtaccccccgggnaggaggtccacctattcctcgtttgttctaggaagtcctaagtcgtaccaacagtcggaaatgaataatgtaatacgtggtaccagtcaacgttcccaagacgacccgacccccaagcctcctacatacttaagtaagaaactttagacggtaaccccgttcccgtacgacggggtccctacggaacccttgttctaccgtgggtaccctacgaacggttcccgtggacccctacccgtacgtacccgtccccgtcccgttaccgaccgtacgttccggtacggttcccgggggtccccttaccccggggtaccgggaacggttaaccggttgggggaacgggtttccgttacggttaacttttaacggttaccgttgggttaccggtttaggggacgttagggggaacccctagggtccccgaagtcgttggttaaggttccgttntaacgtttcgttacccggttacgggaaaccggttcggggaaccccttacgggtacccgttacccgttaaccgggttctaaccccgggg

SEQ ID NO: 335741 - DNA, 527 bp, Homo sapiens
  misc_feature: GZ8MTXP02JYS16.2.49.E05.1.454.CMB.2.raw
tcagacgctcgacacacgaccggtgctcgatttagagcgactagcaacacacaaagggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttccccaagagccggcccccaagctcctcatctatagaaattatgaacccggtcctcaggggtccctgacccgattctctggctccaagtctggcacctcagccctccctggcccatccaggtgggctccggtccgaggatggaggctgattattactgtgttggatgggacagcagcctgacgtgctactgtcgttcggtaacgtacggaccgacggtacgaccgtaccgtacggtccg

SEQ ID NO: 335742 - DNA, 507 bp, Homo sapiens
  misc_feature: GZ8MTXP02F2X0D.2.49.E05.1.454.CMB.2.raw
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttcccaagagcggcccccaagctcctcatctatagaaattatgaaccggtcctcaggggtcccctgacccgattctctggctccaagtctggcacctcagccctcctggcccatccagtgggctccggtccgaggatgaggctgattatactgtgtgatgggacagcagcctgagtgcttatgtcttcggaactgggaccacggtcaccgtcctaggtc

SEQ ID NO: 335743 - DNA, 517 bp, Homo sapiens
  misc_feature: GZ8MTXP02HB084.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcacccctcctcactcactgtgcagggtcctgggcccagtctgtgctgactcagcccaccctcagcgtctggtaccccccgggnagagggtcaccatctcttgttctggaagcatgtccaacatcggaagtgataatgtatactggtaccagcagttccccaagagccggcccccaagctcctcatctatagaaattatgaaccggtcctcaggggtccctgaccgattctctggctccaagtctggccacctcacgcctccctggcccatccagtgggctccggtccgaggactgaggctgattatactgtgttggatggacagcagcctgacgtgcttatgtcttcggaacgtcggaccacggtcaccgtcgtacggtcg

SEQ ID NO: 335744 - DNA, 520 bp, Homo sapiens
  misc_feature: GZ8MTXP02GDMJ5.2.49.E05.1.454.CMB.2.raw
  modified_base (219)..(219): a, c, t, g, unknown or other
  misc_feature (219)..(219): n is a, c, g, or t
  modified_base (371)..(371): a, c, t, g, unknown or other
  misc_feature (371)..(371): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagagggtcaccatctcttgttctggaagcatgtccaacatcggaagtgataatgtatactggtaccagcagttcccaagacgccggacccccaagcctcctcatctaatagaaattatgaaccggtcctcgacggggtccctgaccgattcnctggctccaagtctgcactcagccctcctgccatcagtcgggctccggtcgaggatgaggctgatttatactgtgtggatgggacagctagctgagtgcttagtcgtcttacggaacgtcgggaccacggtcgaccgtcgtacggtccg

SEQ ID NO: 335745 - DNA, 525 bp, Homo sapiens
  misc_feature: GZ8MTXP02F511R.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcagttcccaagagcggcccccaagcctcctcatctatagaaattatgaacccggtcctcgaggggtccctgaccgattctctggctccaagtctggcacctcacgccctccctggcccatccaggtcgggcctccgggtccgaggatggaggctgattatactgtgttggatgggacagcagcctgagtgcttatcgtcttcggaacgtcggggaccacggtcaccgtcctaggtccg

SEQ ID NO: 335746 - DNA, 523 bp, Homo sapiens
  misc_feature: GZ8MTXP02GF1ZR.2.49.E05.1.454.CMB.2.raw
  modified_base (367)..(367): a, c, t, g, unknown or other
  misc_feature (367)..(367): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggcagagggtcaccatctcttgttctggaagcatgtccaacatcggaagtgataatgtatactggtaccagcagtcccaagacgcggcccccaagcctcctcatctatagaaattatgaaccggtcctcgaggggtccctgacccgattcnctggctccaagtctggcacctcacgccctccctggcccatcaggtcgggctccgggtccgaggatggaggctgtattatactgtgtggatgggacagcacgcctgagtgcttatcgtcttcggaacgtgggaccacggtcaccgtccgtagtaccg

SEQ ID NO: 335747 - DNA, 559 bp, Homo sapiens
  misc_feature: GZ8MTXP02G8GE2.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagcagttcccaagacgccggcccccgagcctcctcatctataagaaattatagaacccggtcctcgacggggtccctgaccgattctctggcctccaagtctggccacctcacgtccctccctggcccatcgaggtcgggcctccgggtcgaggagtggaggtctggtatttacttacgtggttggttggagtgggacagcacgccgtgacgtgtctttagtcgttcgttcggaacgttcgggacccgtacggtccaccggttcgtacggtaccg

SEQ ID NO: 335748 - DNA, 551 bp, Homo sapiens
  misc_feature: GZ8MTXP02GU9AT.2.49.E05.1.454.CMB.2.raw
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (408)..(408): a, c, t, g, unknown or other
  misc_feature (408)..(408): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggnaggagggtcaccatctcttgttctggaagcatgtaccaacatcggaagtgataatgtatactggtaccagcagttcccaagagccggacccccaagctcctcatctatagaaattntgaacccggtccngacggggtccctgacccgattcctctggcctccaagtctggccacctcacgccctcccgnggcccatcgaggtcgggcctccgggtaccgaggatcggaggtctagtattactatgtgttgagttgggacagcgtacgccgtgacgtgtacttacgtgtcgtcgtaacgtacggacgacgtacgtaccgtaccgtacgtaccg

SEQ ID NO: 335749 - DNA, 565 bp, Homo sapiens
  misc_feature: GZ8MTXP02JZGCI.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgttctggaagcatgtcccaacatcggaagtgataatgtatactggtaccagcagttcccaagacgccggcccccaagcctccctcatctaatagaaattatgaacccggtcctcgacggggtccctgaccgtattctctggcctccaagtctggccacctcacgccctcccgtcggcccatcgaggtcgggcctccgggtccgaggatggagctgtatttattacgtgtgttggagtgggacaggcgacggccgtggacgttgtctttagtcgttccgttacgggaacgtcggggacctacgggttccacccggttccgtacggtccg

SEQ ID NO: 335750 - DNA, 529 bp, Homo sapiens
  misc_feature: GZ8MTXP02HZC7K.2.49.E05.1.454.CMB.2.raw
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (423)..(424): a, c, t, g, unknown or other
  misc_feature (423)..(424): n is a, c, g, or t
tcagacgctcgacacacgaccggtgctcgatttagagcgactagcaacacacaaaggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccggggagctagttcagcctgggggtcctgagactctcctgtgcagcctctggattcaccttcagtcgctactggatgcactggtccgcaagttccgagggaggctggagtgggtctcgacgcagttgatccatccgtgggaataggattaacgtacgcggcctcggtgagggcccgatcacatcncaganacaacgccagtaacnctntanatagagaangannagcagagaggacgtagacgacggtcttagttactacgacgacaacgtagtcgtacggtcggtaacggactaacgtacggtacgtacggcggacgacggtacgtag

SEQ ID NO: 335751 - DNA, 543 bp, Homo sapiens
  misc_feature: GZ8MTXP02JVRN7.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgttctggaagcatgtccaacatcggaagtgataatgtatactggtaccagcagttcccaagacgccggcccccaagcctcctcatctaatagaaattatgaacccgtcctcgacggggtcccctgaccgtattctctggctccaagtctggcacctcacgccctccctcggcccatcaggtcgggcctccgggtccgaggatggagctgatttattacgtgttgttggagtgggacagctagccgtgagtgctttagcgttcgttacggaacgtcgggaccgtacggtcctacccgtcgtacggtcc

SEQ ID NO: 335752 - DNA, 510 bp, Homo sapiens
  misc_feature: GZ8MTXP02GOWU2.2.49.E05.1.454.CMB.2.raw
tcagacgctcgacacacgaccggtgctcgatttagagcgactagcaacacacaaaggggtaagctcagcttcagctgtggtagagaagacaggattcaggacaatctccagcatggccggcttccctctcctcctcaccctcctcactcactgtgcagggtcctgggccccagtctgtgctgactcagccaccctcagcgtctggtaccccccgggcagagggtcaccatctcttgttctggaagcatgtccaacatcggaagtgataatgtatactggtaccagcagttccccaaagagcgacccccaagctcctcatctatagaaattatgaaccggtcctcaggggtccctgaccgattctctggctccaagtctgggcacctcagcctccctggcccatcagtgggctccggtccgaggatgaggctgattattactgtgttggatgggacagcagtcctgagtgcttatgtcttcggaactgggaccacggtcaccgtctaggtc

SEQ ID NO: 335753 - DNA, 531 bp, Homo sapiens
  misc_feature: GZ8MTXP02HJ3XD.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggnagagggtcaccatctcttgttctggaagcatgtccaacatcggaagtgataatgtatactggtaccagcagttccccaagagccggacccccaagctcctcatctataagaaattatgaacccggtcctcgacggggtcccctgacccgtattcctctggccttccaagtctggccacctcacgccctccctggcccatcaggtcgggctccggtcgaggatgaggtctgtattatacgtgtgttggagtgggacagcagcctgacgtgcttatgtctcggaacgtggaccacggtcaccgtctaggtccg

SEQ ID NO: 335754 - DNA, 516 bp, Homo sapiens
  misc_feature: GZ8MTXP02H1FR1.2.49.E05.1.454.CMB.2.raw
  modified_base (218)..(218): a, c, t, g, unknown or other
  misc_feature (218)..(218): n is a, c, g, or t
  modified_base (398)..(398): a, c, t, g, unknown or other
  misc_feature (398)..(398): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctggtaccccccgggnagagggtcaccatctcttgttctggaagcatgtccaacatcggaagtgataatgtatactggtaccagcagttccccaagagccggcccccaagctcctcatctatagaaattatgaaccggtcctcaggggtccctgaccgattctctggctccaagtctggccacctcagccctcccnggccatcagtgggctccggtcgaggatgaggctgattattactgtgttggatgggacagcagcctgagtgacttagtcgtcttcggaacgtgggaccacggtcaccgtcgtaggtccg

SEQ ID NO: 335755 - DNA, 583 bp, Homo sapiens
  misc_feature: GZ8MTXP02I8SB0.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgttctggaagcatgtccaacatcggaagtgataatgtatactggtaccagcagttcccaagacgccgcccccaagcctcctcatctaatagaaattatgaacccggtcctacgacggggtccctgaccgtattcctctcggctccaagtctggccacctcacgccctccctggcccatccaggtggcctccgggtccgaggatggaggtctaggtactttattacgtgttggttggagtgggacaggcacgccgtagacggtgtacgtttagtcgttaccgttaccggggaaacgttcgggggaaccctaccgggttaccgtaacccggttcccgtaacggtcccg

SEQ ID NO: 335756 - DNA, 537 bp, Homo sapiens
  misc_feature: GZ8MTXP02IJ8G6.2.49.E05.1.454.CMB.2.raw
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggcagacgggtcaccatctcttgttctggaagcatgtccaacatcggaagtgataatgtatactggtaccagcagttcccaaagacgccggaccccccaagcctcctcatctataagaaattatgaaccggtcctcgacggggtccctgaccgattctctggctccaagtctggccacctcacgccctccctggcccatcagtgggcctccggtcgaggatgaggctgattattactgtgttgatgggacagcagcctgagtgcttatcgtcttacggaacgttcgggaaccgtacggtccaaccgttccgtacggtaccg

SEQ ID NO: 335757 - DNA, 683 bp, Homo sapiens
  misc_feature: GZ8MTXP02HQR0C.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagagggtcaccatctcttgttctggaagcatgtccaacatcggaagtgataatgtatactggtaccagcacgttacccaagagccgacccccaagcctcctcatctaataagtaaattatagaacccgtcctacgacggggtcccctgaccgtattcctcgtggcctacctaagtctggcccacctcacgtccctcccgtggaccctagtccgtagggtcgggggtccctcccggggtacccgaaggggtacttagggacggggtaccttaggtaattttaacgtttaccgttggttgggttagggtaggttacgggggaactaacggaccgtaacggtcccgtttagggaacggttggttaccttttagtcggtttaccggtttaaccggggaaaaccggtttcgggggaaaccccgttaccggggttaccctaaccccgggttcccgtttaaagggtccccg

SEQ ID NO: 335758 - DNA, 503 bp, Homo sapiens
  misc_feature: GZ8MTXP02FZYGU.2.49.E05.1.454.CMB.2.raw
tcagacgctcgacacacgaccggtgctcgatttagagcgactagcaacacacaaagggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttcccaagagcggcccccaagctcctcatctatagaaattatgaaccgtcctcaggggtccctgaccgattctctggctccaagtctggcacctcagcctcctggccatcagtgggctccggtccgaggatgaggctgattattactgtgttggatgggacagcagcctgagtgcttatgtcttcggaactgggacacggtcaccgtcctaggtcc

SEQ ID NO: 335759 - DNA, 555 bp, Homo sapiens
  misc_feature: GZ8MTXP02GBRZD.2.49.E05.1.454.CMB.2.raw
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaggtgtccagtgcgaggtgctgctggtggagtccggggagcttagttcagcctggggggtccctgagactctcctgtgcagcctctggattcaccttcagtcgctactggatgcacgtggttccgccaagttccgagggaggggctggagtgggtctcacgcattgatccatccgagggaataggattaacgtacgcggcctccggtggacgggggcctagttcaccatcaccagacgacacgcaaggacactctgtatctaggaaatgagacagtctacgaggaggacggaggacacgggtcttagtttaactacgtgacaacgtaaaggtgaccggtcggttacgggggataacgtacgacgtacggtggggaccgaggggctagg

SEQ ID NO: 335760 - DNA, 716 bp, Homo sapiens
  misc_feature: GZ8MTXP02FOISQ.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccggcagaggtcaccatctcttgttctggaagcatcgtccaacatcggaagtgataatgtatactggtaccagctacgttcccaagacgccggacccccaagcctcctcatctaatagaaattatggaaccccgtcctcgacggggtcccctggacccgtattcctcgtggtcctaccgaagttcgtgggacctacccgtcaccgtccctcccgtggccctatccgagggttccggggcccgttacccggggcccgggtaagggtacgttacggggaacgggtccgttaggttaaacttttacgtttaaccgttgggttgggtttaggggaagttacgggggaaccagggtacccgaacggtcccgttagggtaacggttcggttaccttttaagttcggtttacccggtttaaccggggaaaaccggttcccgggggtaaaaccccgtacccgggggtttaccctaaacccccgggtttccggttaaacgggggttaccccg

SEQ ID NO: 335761 - DNA, 575 bp, Homo sapiens
  misc_feature: GZ8MTXP02IHEPQ.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggnagagggtcaccatctcttgttctggaagcatgtccaacatcggaagtgataatgtatactggtaccagcagttcccaagacgccggcccccaagcctcctcatctataagaaattatgaacccgtcctcgacggggtccctgaccgtattctctggcctaccaagtctggccaccctcacgtccctcccgtggccctatccgaggtcggggcctcccgggtccgaggagtggaggtctagtatttattacgtgttggttggagtgggacagcagtcctggacgtgtactttagtcgttcgttacggaacgttcggggaccctacgggtacctacccggttccgtaacggtcccg

SEQ ID NO: 335762 - DNA, 500 bp, Homo sapiens
  misc_feature: GZ8MTXP02F2J0P.2.49.E05.1.454.CMB.2.raw
  modified_base (465)..(465): a, c, t, g, unknown or other
  misc_feature (465)..(465): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttcccaagagcggcccccaagcctcctcatctatagaaattatgaaccgtcctcaggggtccctgaccgattctctggctccaagtctggcacctcagccctccctgcccatcagtggctcggcgaggatgaggctgattattactgtgttggatgggacagcagctgagtgcttangtcttggaactgggaccacggtcacgtcctaggtc

SEQ ID NO: 335763 - DNA, 548 bp, Homo sapiens
  misc_feature: GZ8MTXP02I7001.2.49.E05.1.454.CMB.2.raw
  modified_base (445)..(445): a, c, t, g, unknown or other
  misc_feature (445)..(445): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcagtcccaagagccggcccccaagcctcctcatctatagaaattatgaaccggtcctcgacggggtcccctgacccgtattcctcgtggcctaccaagtctggccaccctcacgccctcccgtggcccagtccaggtcggggcctccgggtccgaggntggaggctgtattatactgtgttggagtgggacagcagcctgagtcgcttagtcgtcttacgggaacgttcggggaacctcgggtccaccggtcctacggtcc

SEQ ID NO: 335764 - DNA, 660 bp, Homo sapiens
  misc_feature: GZ8MTXP02IGORD.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtaccccccgggnagagggtcaccatctcttgtctggaagcatgtccaacatcggaagtgataatgtatactggtaccagcagttcccaaagacgccggcccccaagcctcctcatctatagaaattatgaaccggtcctacgaggggtccctgaccgattctctgcctaccgaagtctggccaccctcacgtcccctcctcggcccattccgaggtcggggcccgttcccgggtcccgaaggggtattggaacgggtccttagggtaattttattaaccgttggtttggtttagggaagttgggggaacctaggaccgtaacggtcccgttaggtaagtttacgggtccttttaagtcggtttcccgtttaccggggtaaaaccgttcgggggtaaacccgtacccggggttacccgtaacccccggttaccggtttaacgggtaaccccgg

SEQ ID NO: 335765 - DNA, 511 bp, Homo sapiens
  misc_feature: GZ8MTXP02F89VK.2.49.E05.1.454.CMB.2.raw
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (494)..(494): a, c, t, g, unknown or other
  misc_feature (494)..(494): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttcccaagagcggcccccaagctcctcatctaatagaaattatgaaccgtcctnaggggtccctgaccgattcnctggctccaagtctggcacctcagccctccctggcccatccagtgggcctccggtccgagggatgaggctgattattactgtgttggatgggacagcagctgagtgcttatcgtcttcggaacgtggaccncggtcaccgtctaggtc

SEQ ID NO: 335766 - DNA, 563 bp, Homo sapiens
  misc_feature: GZ8MTXP02I8RLE.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtctcggtacccccgggcagagggtcaccatctcttgttctggaagcatcgtccaacatcggaagtgataatgtatactggtaccagcacgttcccaagacgccggcccccgagcctcctcatctaatagtaaattatgaacccggtcctcgaggggtcccctgacccgtattccgtctcggcctaccaagtctcggccaccctcacgccctcccgtggcccatcaggtgggccctcggtccgaggatggacggctggtattattacgtgtggtgagtgggacagcacgtcctgacgtgtacttagtcgttacgtacggaacgttcgggacctaccggtctacccggtccgtaggtacccg

SEQ ID NO: 335767 - DNA, 538 bp, Homo sapiens
  misc_feature: GZ8MTXP02H59WV.2.49.E05.1.454.CMB.2.raw
  modified_base (219)..(219): a, c, t, g, unknown or other
  misc_feature (219)..(219): n is a, c, g, or t
  modified_base (365)..(365): a, c, t, g, unknown or other
  misc_feature (365)..(365): n is a, c, g, or t
  modified_base (437)..(437): a, c, t, g, unknown or other
  misc_feature (437)..(437): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctggtaccccccgggnagagggtcaccatctcttgtctggaagcatgtccaacatcggaagtgataatgtatactggtaccagcagttcccaagagccggcccccaagcctcctcatctataagaaattatgaaccggtcctcgacggggtccctgaccgtnttctctggcctccaagtctggccaccctcacgccctccctggcccatcaggtcgggcctccgggtccgaggntggaggctgattattactgtgttggatgggacagcagctgagtgtcttatgttacgttcggaacgtgggaacctacgggtccacccggtcgtaacggtccg

SEQ ID NO: 335768 - DNA, 520 bp, Homo sapiens
  misc_feature: GZ8MTXP02GD0MQ.2.49.E05.1.454.CMB.2.raw
  modified_base (363)..(363): a, c, t, g, unknown or other
  misc_feature (363)..(363): n is a, c, g, or t
tcagacgctcgacacacgaccggtgctcgatttagagcgactagcaacacacaaaggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttccccaagagcggcccccaagctcctcatctatagaaattatgaaccgtcctcaggggtccctgacccgattcnctggctccaagtctggcacctcagccctccctggcccatccagtggggcctccgggtcccgagggactggacgggctggatttattactgttgttggatgggacagcagcctgagtgcttatgtcttcggaactgggaccacggtcacgtctaggtc

SEQ ID NO: 335769 - DNA, 540 bp, Homo sapiens
  misc_feature: GZ8MTXP02FV3DV.2.49.E05.1.454.CMB.2.raw
  modified_base (366)..(366): a, c, t, g, unknown or other
  misc_feature (366)..(366): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtaccaacatcggaagtgataatgtatactggtaccagcagttcccaagacgccggcccccaagcctcctcatctatagaaattatgaacccgtcctcgacggggtcctgaccgnttctctggctccaagtctggccacctcacgccctccctggccatcgaggtcgggcctccgggtccgaggatggaggctgtattattactgttgtggatgggacagcacgctgagtcgctttatcgtcgttacggaacgttcgggaacctacgggtcaaccgtccgtaggtaccg

SEQ ID NO: 335770 - DNA, 524 bp, Homo sapiens
  misc_feature: GZ8MTXP02FW2QY.2.49.E05.1.454.CMB.2.raw
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcagttcccaagagcggcccccaagctcctcatctatagaaattatgaaccgtcctcgacggggtccctgaccgattctctggctccaagtctggcacctcacgcctccctggcccatcagtggctccggcgagatgaggctgattattacgngtgtggatgggacagcacgcngacgtgtcttatcgtcttacgggaactcggggaacctacgggtccaaccggtcctagggtaccc

SEQ ID NO: 335771 - DNA, 605 bp, Homo sapiens
  misc_feature: GZ8MTXP02F6UWW.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagcacgttcccaagacgccggacccccaagcctcctcatctaatagaaattatgaacccgtcctcgacggggtccctgaccgtattcctctggcctccaagtctggcctacctcacgtccctccgtcggccctatcgaggtcgggccgtcccgggtccgaagggtatgggaacggtcgttaggtatttagttaccgtggttggttggtaagtcggggactaggctacggtccgttaggacgttcgtaccgtttagtcggttccgttacgggaaacgttcggggaaccctacgggtaccacccggtccgttacgggtacccg

SEQ ID NO: 335772 - DNA, 547 bp, Homo sapiens
  misc_feature: GZ8MTXP02HELAX.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcacccctcctcactcactgtgcagggtcctgggcccagtctgtgctgactcagcccaccctcagccgtctcggtaccccccgggnaggagggtcaccatctcttgttctggaagcatgtccaacatcggaagtgataatgtatactggtaccagcagttcccaagacgccggacccccaagcctcctcatctaataagtaaattatgaacccggtcctcgacggggtccctgaccgtattctctggcctccgaagtctaggccacctcacgccctccgtgccatcaggtggccgtccggtcgaggactgaggtctgtacttattcgtgtgttggatgggacagcgaggcctggtacgtgtacttagtcgtcgttacggaacgtcggacctacggtcaccgtcgtaggccg

SEQ ID NO: 335773 - DNA, 534 bp, Homo sapiens
  misc_feature: GZ8MTXP02JT27H.2.49.E05.1.454.CMB.2.raw
tcagacgctcgacacacgaccggtgctcgatttagagcgactagcaacacacaaaggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcagttcccaagagccggcccccaagctcctcatctatagaaattatgaacccggtcctcgaggggtccctgacccgtattcctcgtggccttccaagtctgggccacctcagccctccctggcccatcagtcgggctccggtccgaggatggaggctgattattactgttgttggatgggacagctagcctgagtgcttagtcgtcttacggaactcggggaccacgggtcacccgtcgtaggtccg

SEQ ID NO: 335774 - DNA, 568 bp, Homo sapiens
  misc_feature: GZ8MTXP02GNVFQ.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtaccaacatcggaagtgataatgtatactggtaccagcagtcccaagacgccggacccccaagcctcctcatctaataagaaaattatagaacccggtcctacgacggggtccctgaccgtattcctctggcctaccaagtctggccacctcacgccctccctggcccactcgaggtcgggcctcccggtccgaggatggaggtctagtattattacgttgtggttggatgggacagcagcctggacgtgactttagtcgttcgttacggaaacgttcgggaacccgtacggtccacccggttccgtacggtacccg

SEQ ID NO: 335775 - DNA, 548 bp, Homo sapiens
  misc_feature: GZ8MTXP02GJQPO.2.49.E05.1.454.CMB.2.raw
  modified_base (440)..(440): a, c, t, g, unknown or other
  misc_feature (440)..(440): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccggcagagggtcaccatctcttgtctggaagcatgtccaacatcggaagtgaataatgtatactggtaccagcacgttcccaagacgccggcccccaagcctcctcatctaataagaaattatgaacccgtcctcgaggggtccctgaccgtattctctggcctaccaagtctggccacctcacgtccctccctggcccatcgagtcgggctcccgggtcgaggntgaggtctgtattatacgtgtgttggatgggacagcagcctggagtgtctttagtcgttcttacggaacgttcgggaaccctacggtccaaccgttccgtaggtaccg

SEQ ID NO: 335776 - DNA, 547 bp, Homo sapiens
  misc_feature: GZ8MTXP02GIAPF.2.49.E05.1.454.CMB.2.raw
  modified_base (218)..(218): a, c, t, g, unknown or other
  misc_feature (218)..(218): n is a, c, g, or t
  modified_base (474)..(474): a, c, t, g, unknown or other
  misc_feature (474)..(474): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtccaacatcggaagtgataatgtatactggtaccagcagttcccaagagccggcccccaagcctcctcatctatagaaattatgaacccggtcctcgacggggtccctgaccgattcctctggtcctcaagtctcgggcaccctcacgccctccctggcccatcgagtcgggcctccgggtccgaggatggaggtctgtattattacgtgtgttgagtgggacngcacgcctggacgtgtcttagtcgttcgttacggaacgtcgggaaccgacggttcgacccgtcgtacggtccg

SEQ ID NO: 335777 - DNA, 584 bp, Homo sapiens
  misc_feature: GZ8MTXP02JTFFN.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttcccctctcctcctcacccctcctcactcactgtgcagggtcctgggcccagtctgtgctgactcagccaccctcagcgtctcggtaccccccgggnagagggtcaccatctcttgtctggaagcatgtccaacatcggaagtgataatgtatactggtaccagcagttcccaagacgccggacccccaagcctcctcatctataagaaattatagaacccggtcctacgacggggtcccctgaccgtattccgtctggcctaccaagtctggccaccctcacgccctccctggccctatcaggtcgggccttccgggtcccgaggtactggaggctgtattagttacgtggttggtttgggagttagggggaccaggccgtacgtccgtggacgtggtctttacgtcgttcgttcggaacgtcgggacccgtacggtccaccggtccgtaggtacccg

SEQ ID NO: 335778 - DNA, 600 bp, Homo sapiens
  misc_feature: GZ8MTXP02GEHTL.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtaccaacatcggaagtgataatgtatactggtaccagcagttcccaagacgccggacccccaagcctcctcatctataagaaattatcgaacccgtcctacgacggggtccctgaccgattctctggccttaccgaagtctcggccaccctcacgccctcccgtcggccctatccgtacggtcggggtcccgttcccgggtccggaagggtacgtgggacggtcgtagtaatttattacgttgttggttaggagtgggacagcgacgtccgtggacgtgactttagtcgttacgttacggaacgttcggggaacccgtacgggtcctaacccggtccgtaacggtacccg

SEQ ID NO: 335779 - DNA, 563 bp, Homo sapiens
  misc_feature: GZ8MTXP02G5PWA.2.49.E05.1.454.CMB.2.raw
  modified_base (219)..(219): a, c, t, g, unknown or other
  misc_feature (219)..(219): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgtctggaagcatgtaccaacatcggaagtgataatgtatactggtatcagcagttcccaagcgccggacccccaagcctccctcatctaatagaaattanacgaacgtcctcgacggggtccctgaccgtnttcctcgtcggcctaccgaagtctcggccacctcacgcccgtccctggcctatcgaggtcgggcctccgggtcgacggatggagctgtattagttacgtggttgttggagtgggacaggcagtccgtaggagttcgtcgttagtcggttacgtaacggaacgtcgggacctacggtcctaacccggtcgtaacgg

SEQ ID NO: 335780 - DNA, 518 bp, Homo sapiens
  misc_feature: GZ8MTXP02FR270.2.49.E05.1.454.CMB.2.raw
  modified_base (370)..(370): a, c, t, g, unknown or other
  misc_feature (370)..(370): n is a, c, g, or t
tcagacgctcgacacacgaccggtgctcgatttagagcgactagcaacacacgaaagggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtaccccccgggcagagggtcaccatctcttgttctggaagcatgtccaacatcggaagtgataatgtatactggtaccagcagttcccaagagccggcccccaagctcctcatctatagaaattatgaaccggtcctcgacggggtccctagacccgattcnctggctcccaagtctggccacctcacgccctcctggccatccagtcgggctccggtccgaggatgaggctgattatactgtgttgatggacagcagctgagtgcttatcgtcttacggaacgtggaccacggtcaccgtcgtaggtcc

SEQ ID NO: 335781 - DNA, 570 bp, Homo sapiens
  misc_feature: GZ8MTXP02F99EE.2.49.E05.1.454.CMB.2.raw
  modified_base (397)..(397): a, c, t, g, unknown or other
  misc_feature (397)..(397): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (531)..(531): a, c, t, g, unknown or other
  misc_feature (531)..(531): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctatttaaaggtgtccagtgcgaggtgctgctgggtggaggtccgggggaggcttagttcgaggcccgggggtccctgagactctcctgtgcagcctctggtattcaccttcagtcgctactggatgcacgtcggtccgaccaaggttccgaaggggaaggggctgggagtgggtctcgacgcatttgatccaattcgtaggggaaattaggaacttaaacgtacggccggccttcggngggacggggcctatcacatctacagagaacaacgctaagaacnctctgtancgtaggaaaatggancagtctagagacgngagacaggcttagtttaaatcagactacaaagtcgaacggtcggttacgggganaacgtgaaccgttaggacgggggaccaggggctagtcgg

SEQ ID NO: 335782 - DNA, 589 bp, Homo sapiens
  misc_feature: GZ8MTXP02HD0D9.2.49.E05.1.454.CMB.2.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcaccatctcttgtctggaancatgtccaacatcggaagtgataatgtatactggtaccagcagttcccaagagccggccccaagcctcctacatctataagtaaattatgaacccggtcctccgaggggtcccctgaccgtattcctcgtggcctaccgaagttcgtggcctacctcgaccgtccctcccgtggccctatcgaggtcggggtcctccgggtccgaggacgtgaggtctagtattagttcgtggttgttggagtggggacagcacgtccgtagtacggtgtcgtttagtcggttcgtttaccgggaacgttcggggaacccgtacgggtaccgtaacccggtccgtacggtacccg

SEQ ID NO: 335783 - DNA, 518 bp, Homo sapiens
  misc_feature: GZ8MTXP02GS2H5.2.49.E05.1.454.CMB.2.raw
  modified_base (220)..(220): a, c, t, g, unknown or other
  misc_feature (220)..(220): n is a, c, g, or t
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnaggaggtcaccatctcttgttctggaagcatgtccaacatcggaagtgataatgtatactggtaccagcagttcccaagagcggcccccaagctcctcatctatagaaattatgaaccgtcctcacggggtcctgaccgatctctggctccgaagtctggcacctcagccctcccgtggcccatcagtcgggctcggtccgaggntgaggctgattattactgtgtgatggacagcagcngagtgcttagtcgtcttacggaacgttcgggacctacggtacaccgtccgtaggtccg

SEQ ID NO: 335784 - DNA, 563 bp, Homo sapiens
  misc_feature: GZ8MTXP02HKQ5J.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgttctggaagcatgtccaacatcggaagtgataatgtatactggtaccagcagttcccaagagccggcccccaagcctcctcatctatagaaattatgaacccggtcctcgacggggtcccctgacccgtattctctggcctaccaagtctggccacctcacgccctcccgtggcccatccgagtcgggcctccgggtcgaggatggaggtctgattattacgtggtgttggagtggggacagcgacgtcctggagtgtactttagtcgttcgttacgggaacgttcggggaaccctacgggtccacccggttccgtaacggtccg

SEQ ID NO: 335785 - DNA, 599 bp, Homo sapiens
  misc_feature: GZ8MTXP02JRK7H.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggcagagggtcaccatctcttgttctggaagcatgtccaacatcggaagtgataatgtatactggtaccagcagttcccaagagccggcccccaagcctcctcatctatagaaattatgaacccggtcctcgacggggtcccctgaccgtattctcgtggcctaccaagtctggccaccctcacgccctcccgtcggcccatccgaggtcgggccgtcccgggtaccgaggtacgtggacgggtccttaggtactttaagttacgtggttggtttagggaggttcggggacgagcgtacggtccgtggacgtgtacgttagtcgttcgttacggtaacgtcggggaacctacgggtaccgtacccggtccgttaacggtccg

SEQ ID NO: 335786 - DNA, 534 bp, Homo sapiens
  misc_feature: GZ8MTXP02IGFJ7.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgtctggaagcatgtccaacatcggaagtgataatgtatactggtaccagcagttcccaagacgccggcccccaagcctcctcatctataagaaattatgaacccggtcctcgacggggtccctgaccgtattctctggcctccaagtctggccacctcacgtccctccctggcccatccgagtcgggcctccggtccgaggatcggaggtctagtatttattacgtgtgttggagtgggacagcagctgagtgcttatcgtctcggaacgtcgggactacggtcaccgtcgtaggcg

SEQ ID NO: 335787 - DNA, 615 bp, Homo sapiens
  misc_feature: GZ8MTXP02GYX9C.2.49.E05.1.454.CMB.2.raw
  modified_base (426)..(426): a, c, t, g, unknown or other
  misc_feature (426)..(426): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccggcagagggtcacatctcttgttctggaagcatgtaccaacagtcggaagtgataatgtatactggtaccagctacgttcccaagacgccggacccccaagcctcctcatactaataagtaaattagtgaacccggtcctacgacggggtccctaggaccgtattctcgtggtcctccgaagtcgtcggcccacctcacgtccctcccgnggcccatcgacggtcgggcccgtcccgggtaccgaagggtacgtaggacgggtctaggtaactttagttacgttggttaggttgggagttcggggaacacgcgacgtccgtggacggtgtacgtttagtcggttacgttacgggaacgttcggggaccctacggtcccaccggttccgtacggtacccg

SEQ ID NO: 335788 - DNA, 525 bp, Homo sapiens
  misc_feature: GZ8MTXP02JEOKI.2.49.E05.1.454.CMB.2.raw
  modified_base (386)..(386): a, c, t, g, unknown or other
  misc_feature (386)..(386): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgaataatgtatactggtaccagcagttcccaaagcgcggcccccaagctcctcatctatagaaattatgaaccggtcctcgaggggtcccctgacccgtattctctggcctaccaagtcngggcaccctcacgccctccgtggcccatccaggttcgggctccgggacaggatggagtctgatttatactgtgtggatgggacagcagctgagtgcttatcgtcttaggaacgtgggacctacggcaccgtctaggtcc

SEQ ID NO: 335789 - DNA, 657 bp, Homo sapiens
  misc_feature: GZ8MTXP02GY1XM.2.49.E05.1.454.CMB.2.raw
  modified_base (221)..(221): a, c, t, g, unknown or other
  misc_feature (221)..(221): n is a, c, g, or t
  modified_base (323)..(323): a, c, t, g, unknown or other
  misc_feature (323)..(323): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtacccccgggnaggaggtcaccatctcttgttctggaagcatgtaccaacatcggaagtgataatgtatactggtaccagcacgttcccaaagcgccggcccccaagcctccncatctaataagtaaattatacgaaacccggtcctacgacggggttcccctggaacccgtattccgtctcggcctaccgaagttcctcgggcctacccgtcacgtccctcccgtggcccatccgaggttcgggcccttaccggggccgaagggtacgtggacgggtctaggttaatttacttacgttggttggttgggtaagtcgggggaacaggtccgaacgtccgttggacggttcgtacttttaagtcgggttaccgtttacgggaaacccgttcgggggtaaaccccgtaccggggttaccctaacccggttaccggtaacggttaccccg

SEQ ID NO: 335790 - DNA, 527 bp, Homo sapiens
  misc_feature: GZ8MTXP02JTYVH.2.49.E05.1.454.CMB.2.raw
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
  modified_base (496)..(496): a, c, t, g, unknown or other
  misc_feature (496)..(496): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttcctgttgctatttaaaaggtgtccagtgcgaggtgctgctggtggagtccgggggaggcttagttcagccgtggggggtccctgagactctcctgtgcagcctcgtggattcaccttcagtcgctactggatgcactggttccgccaagttccgaggggaagggctggagtggggtcncgacgcattgatccatccgtgggaatagattaacncgcgctcgnggngggccgattcacatctcaganacacgcaggacactctagtactcgtaggaaatgagcagtcncaggaggcgagacacggtctagtttactacngacacgaaggtcgacgcggttcggggangtcggactacggtcggggaccacggggtcag

SEQ ID NO: 335791 - DNA, 677 bp, Homo sapiens
  misc_feature: GZ8MTXP02GWDXG.2.49.E05.1.454.CMB.2.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagaggtcacntctcttgtcngancatncantgatnatatgtatactgacagctacgtaccaagacgccgaccccagcctcctcatactaataagtaaattagtacggaaccccggtcctacggtacggggtcccctaggtaccgttatttccgtcgtcggtaccctaccgaagttccgtacggaccctaccctcgaccgtcccctcccgtcggaccctagtccgacgggtccgggtcccgttacccgggtaccggtaagggtacgtacgggacggtcttaggttaacgtttaacgttacgttgggttaggttagggacggttacggggaacgaggacgtacggtccgtagggtacggttcgttacgtttacgttcggtttccggttaacggggtaaccggtaccggggtaaccccggtaccgggtacccgtaaccccggttaccggtaacggtaccg

SEQ ID NO: 335792 - DNA, 575 bp, Homo sapiens
  misc_feature: GZ8MTXP02IMU22.2.49.E05.1.454.CMB.2.raw
tcagacgctcgacacacgaccggtgctcgatttagagcgactagcaaacacacaaaagggggggaagctcagcttcagctgtggtagagaagacaggattcaggacaatctccagcatggccgacttccctctcctcctcaccctcctcactcactgtgcagggtcctgggcccagtctgtgctgactcagccaccctcagcgtctcgggtaccccccgggcagagggtcaccatctcttgttctggaagcatgtccaacatcggaagtgataatgtatactggtaccagcagtccaaagacgccggcccccaagcctcctcatctatagaaattatgaaccggtcctcgacggggtccctgaccgtattctcgtggcctaccaagtctggccaccctcacgtccctcccgtggcccatccgaggtcggggcctcccgggtccgaggatggaggtctagtatttattacgtggttgttggagtgggacagcgacgtccgtgagttgtactttagtcgttcgttacgggaaacgttcggggaaccctacggtaccgaccggttccgttaacgggcc

SEQ ID NO: 335793 - DNA, 742 bp, Homo sapiens
  misc_feature: GZ8MTXP02HM21H.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcaccatctcttgtctggagcatgtccaacatcggaagtgataatgtatactggtaccagctacgttacccaagacgcccggaccccaagtcctcctcatcctaataagtaaattatacggaaacccggttccctacgtacggggtcccctggaacccgtatttccgtcgtcggccttaccgaaaggttcctacgggtaccacccttcgaaccggtccccttccccgtgggacccctaagttccgtaacggggttccgggggcccgttaccccgggggtaccggaaggggtacgtacgggtacgggttacgttagttaacgtttaacgttttaccggttagggtttgggtttaggggtaggttacgggggaaaccctagggtacccgaacggtcccgttaggtaaacggttcggttaaccttttaggttccggtttccgttaaccggggtaaaccgttccggggaaaccccgtaccgggttaccctaaccccgggttacccgttaaggggtacccccg

SEQ ID NO: 335794 - DNA, 585 bp, Homo sapiens
  misc_feature: GZ8MTXP02HLPO9.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagcacgttcccaagagccggaccccaagcctcctcatctataagtaaattagtagaacccgtcctacgacggggtccctgaccgattcctcgtcggcctaccaagttctacgggccacccgtcacgtccctcccgtggcccagttcgaggtcgggacctcccgggtaccgaggacgttggacggtctaggtatttattacgtggtgttggagtggacagcacgtctggagtggtacttagtcgttacgtacggaaacgttcggggaacccgtacggtcccacccggtacgttaacggcccg

SEQ ID NO: 335795 - DNA, 523 bp, Homo sapiens
  misc_feature: GZ8MTXP02H7OGG.2.49.E05.1.454.CMB.2.raw
  modified_base (218)..(218): a, c, t, g, unknown or other
  misc_feature (218)..(218): n is a, c, g, or t
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggnagagggtcaccatctcttgtctggaagcatgtccaacatcggaagtgataatgtatactggtaccagcacgttcccaagacgccggcccccaagcctcctcatctatagtaaatatgaaccgtcctcgaggggtcccctgaccgtattcctctcggcctccaagtctggccacctcacgccctccctggccatcagtcgggctccggtcgaggntggaggctgattattacgtgtgttggatgggacagcagcctgacgtgcttangttctcggaacgtcgggaccacggtcaccgtctacggtc

SEQ ID NO: 335796 - DNA, 627 bp, Homo sapiens
  misc_feature: GZ8MTXP02GC2Y3.2.49.E05.1.454.CMB.2.raw
  modified_base (225)..(225): a, c, t, g, unknown or other
  misc_feature (225)..(225): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtaccccccggcaggngggtcaccatctcttgttctggaagcatgtccaacatcggaagtgataatgtatactggtaccagcagttccaagacgccggcccccaagcctcctcatctatagaaattatgaaccgtcctcgagggtccctgaccgtattcctctggcctccaagtcgtcggcctacctcacggtccctcccgtcggccctatccgaggtcggggcccgtcccgggtcccggaggtactgggaacgggtctaggtaatttagttaaccgttggttgggtttagggaaggttcgggggaactacgggacgtacgcccgttgggaacgttcggtcctttaagtccgttacgtttacggaaccggtcgggtaacccgtacccgggtcctacccggtccgttaacgggtacccg

SEQ ID NO: 335797 - DNA, 673 bp, Homo sapiens
  misc_feature: GZ8MTXP02J1LFE.2.49.E05.1.454.CMB.2.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagaggcacntctcttgtcngancatctacaacagcggagtgatatgtatacgtcgtacagctacgtaccaagcgcccggaccccaagcctcctacactactaataagtaaattagtacggaaccccggtcctacggtacggggtccctaggtaccgttacttcctcgtacggtcctaccgtaacgttccgtacggacctaccctccgtaccgtccccttcccgtcggaccctacgtccgtacgggtcggggtacccgtcccgggtaccggaggtacgtcgggacggtcgttagtacgtttaacgttacgttggttaggttgggtacggtacggggtacacggacgtacggtccgtaggtacggttcgttacgttacgttccggttacggttacgggtaaccggttaccggggaacccgtaccgggtacccgtacccggttaccggtacggtcccg

SEQ ID NO: 335798 - DNA, 578 bp, Homo sapiens
  misc_feature: GZ8MTXP02HJJTQ.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggnagagggtcaccatctcttgttctggaagcatgtccaacatcggaagtgataatgtatactggtaccagcagtcccaagacgccggacccccaagcctcctcatctataagaaattatgaacccggtcctcgacggggtccctgaccgattcctctggcctaccgaagtctggccaccctcacgtccctcccgtcggcccagtccgaggttcgggcctcccgggtccgaaggactggacggtctaggtatttacgttacgtggttgttggagtggggacagcagtccgtggagtgtcttagtcgttccgttaccggaacgttcgggacccgtacggtcctacccgtccgtaacggtccg

SEQ ID NO: 335799 - DNA, 644 bp, Homo sapiens
  misc_feature: GZ8MTXP02GZOMW.2.49.E05.1.454.CMB.2.raw
  modified_base (216)..(216): a, c, t, g, unknown or other
  misc_feature (216)..(216): n is a, c, g, or t
tcagacgctcgacacacgaccggtgctcgatttagagcgactagcaacacacaaagggggggaagctcagcttcagctgtggtagagaaaacaggattcaggacaatctccagcatggccggcttccctctcctcctcaccctcctcactcactgtgcagggtcctgggcccagtctgtgctgactcagccaccctcagcgtctggtacccccggnagagggtcaccatctcttgttctggaagcatgtccaacatcggaagtgataatgtatactggtaccagcagttccccaagacgccggacccccaagcctcctcactctaataagaaattataggtaacggtcccctcgacggggtccctggaccgtattctcgtcggctaccgaagtctggtccaccctcacgtccctcccgtggccatcgacggtcgggtcctacccgggtccgagggtacgtggacggcgttagtatttacgttacgtaggttggttgggtacgtgggggacctaggccgacggtccgtggtagttcggtaccgtttaagttcggttccgttaccgggtaaccggttaacgggggtaaccccgtaccgggttacccgaccccggtttacccggttaacggttacccgaaaccccgg

SEQ ID NO: 335800 - DNA, 633 bp, Homo sapiens
  misc_feature: GZ8MTXP02JVPHE.2.49.E05.1.454.CMB.2.raw
  modified_base (218)..(218): a, c, t, g, unknown or other
  misc_feature (218)..(218): n is a, c, g, or t
  modified_base (334)..(334): a, c, t, g, unknown or other
  misc_feature (334)..(334): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtccaacatcggaagtgataatgtatactggtaccagcagttcccaagagccggacccccaagcctcctcatctaatagaaattnagaacccggtcctcgacggggtcccctggaccgtatttcctcgtcggtccttaccgaaagttcctacgggccctaacccgttccgaacggtcccccttccccgtcggcccctaatccgaacgggttcggggtcccgtccccgggtaccggagggacgtgggaggtccgtggtaatttagttacgttggttgttagggagtcggggacaggcacggtcctaggacgttgactttagtcgttaccgttacggaacgtcgggggaaccctacgggtccctacccggtccgtacgggtacccg

SEQ ID NO: 335801 - DNA, 557 bp, Homo sapiens
  misc_feature: GZ8MTXP02I46X6.2.49.E05.1.454.CMB.2.raw
tcagacgctcgacacacgaccggtgctcgatttagagcgactagcaacacacaaaggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccgggggaggcttagttcagcctggggggtccctgagactctcctgtgcagcctctggattcaccttcagtcgctactggatgcactggttccgccaagttccgagggagggctggagtgggtctcgacgcattgactccatccgtagggaataggattaacgacggccggccgtccggtggacggggcctattccacctactcctccgagacgaaccaacgcaacggacactctagtactcgtaggaaactgacgtcgagtctacgaggaggacggaggaacgcggtcttaggtttatacgtgacacgtaagtcgaccgtcggttcgggatcgtgacgttacggcgggcaggctagg

SEQ ID NO: 335802 - DNA, 563 bp, Homo sapiens
  misc_feature: GZ8MTXP02HOSWB.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtaccccccgggnaggagggtcaccatctcttgttctggaagcatgtccaacatcggaagtgataatgtatactggtaccagcagttccccaagacgccggcccccaagcctcctcatctaataagtaaattataggaaccccgtcctcgacggggtccctagacccgtattcctcgtggcctaccgaagtcgtggcccacccttcacgtccctcccgtggcccattcgaggtcgggcctccgggtccgaggtatggaggtctagtatttagttactgtgttggatgggacagcagcgtgagtgcttagtcgttctaggtaacgtcggacctacggtccaccggtctacggtcc

SEQ ID NO: 335803 - DNA, 629 bp, Homo sapiens
  misc_feature: GZ8MTXP02GZ2UN.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtctcggtacccccggnaggaggtcaccatctcttgtctggaagcatcgtaccaacatacggaagtgaataatgtatacgtggtaccagcacgttaccaagacgccggacccccaagcctcctacatctaataaagtaaattagtagtaaccggtccctacgaacggggttcccctaggaccgtacttcctacgtcggtcctacccgtaagttccgtcgggacctacccgtccaacgtcccctcccgtcggcccagtccgaggtcgggtacctcccggggtccgaggtagtggacggcttagtaattacttacgtgttaggttaggaagtgggaacgagcgacgtccgttaggagtcgtactttagtcgttaccgttacggaacgtacgggaccgtacggtcccgtacccggtcgtacggtacccg

SEQ ID NO: 335804 - DNA, 597 bp, Homo sapiens
  misc_feature: GZ8MTXP02FW76A.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtacccaacatcggaagtgaataatgtatactggtaccagcagttcccaagacgccggacccccaagcctcctcatctataagaaattagacgaacccggtcctacgacggggtcccctggaccgtattctcgtggtcctaccaagtctcggcacctcacgccctccctggcccagtccgaggtcgggcctcccgggtccgaggactggacggtctaggtatttattacgttggttggttgggtagtcggggactagggctacggtccgtaggacgttgtactttagttcggtccgttacggaacgttcgggaccctacggtcccgaccggttaccgtaggtaccc

SEQ ID NO: 335805 - DNA, 569 bp, Homo sapiens
  misc_feature: GZ8MTXP02I63E2.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtctcggtacccccgggnaggaggtcaccatctcttgttctggaagcatgtccaacatacggaagtgataatgtatactggtaccagcagttcccaaagagccggacccccaagcctcctcatctataagaaattatcgaaacccgtcctcgacggggtcccctgaccgtattctctggctaccaagtctggaccacctcacgccctccgtcggccatccgaggtcggccgtcccggtccgaggactggacggtctagtatttatacgtggttgtggtagtgggacagcacgtcctaggacgtgtctttatcggttacgttacggaacgttcgggaccgacggttccaaccgttccgtaggacccg

SEQ ID NO: 335806 - DNA, 552 bp, Homo sapiens
  misc_feature: GZ8MTXP02I3XJ2.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgttctggaagcatgtccaacatcggaagtgataatgtatactggtaccagcagttcccaaagagccggacccccaagcctcctcatctaataagaaattatgaacccggtcctcgacggggtcccctgacccgtattcctcgtggcctccaagttcctgggccacctcacgccctccctggcccatcaggtcgggcctccgggtccgaggatcggaggtctagtattatactgtgttggagtgggacagcacgctagagtgcttagtcgtcttacggaacgttcgggaccacgggtcacccgtccgtaaggtccg

SEQ ID NO: 335807 - DNA, 570 bp, Homo sapiens
  misc_feature: GZ8MTXP02IJLBC.2.49.E05.1.454.CMB.2.raw
  modified_base (490)..(490): a, c, t, g, unknown or other
  misc_feature (490)..(490): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtaccaacatcggaagtgataatgtatactggtaccagcacgttccaaagagcccggacccccaagcctcctcatctaataagaaattatcgaaccgtcctcgacggggtccctgaccgattctctggcctaccagtctgcctacctcacgccctcccgtggcccatccgaggtcggggtcctccgggtccgaggtacgtggacggtctagtatttacttacgtgttggttggatggacnggcagtctggagttgactttagcgtttcgtacggaaacggttcgggaaccctacggtaccgacccgttacgtacgggtcc

SEQ ID NO: 335808 - DNA, 627 bp, Homo sapiens
  misc_feature: GZ8MTXP02JRAEZ.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagagggtcaccatctcttgttctggaagcatgtccaacatcggaagtgataatgtatacgtggtaccagcacgttcccaaagacgccggacccccaagcctccctcacttcctaataagtaaaactttagtacggtaaaccccggtccctacgtaacgggggttccccctaggaacccgtatttccgtcgttcgggcccttaccaaggtccgttagggcccaacccgttcaccggtcccctcccgtcggcccatccgaggttcgggccctccgggtaccgaggcgtggacggtctgatttatacgtgtggttggatggggacagcagcgtgacgtgactttagtcgttcgttacgggaacgttcggggaaccctacggggtaccctaccggttcccgtaagggtcccg

SEQ ID NO: 335809 - DNA, 548 bp, Homo sapiens
  misc_feature: GZ8MTXP02FLUOM.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggcagagggtcaccatctcttgttctggaagcatgtccaacatcggaagtgataatgtatactggtaccagcagtccaagagccggcccccaagcctcctcatctatagaaattatgaaccggtcctcgaggggtcccctgaccgtattctctggctaccaagtctggccacctcacgccctccctggcccatccagtcgggcctcccgggtccgagggatggaggtctgtaatttattacgtgtgttggagtgggacagcagctgagtgcttagtcgtcgttacggaaacgtcggggaaccctacgggtccaacccggtcctaggtaccg

SEQ ID NO: 335810 - DNA, 684 bp, Homo sapiens
  misc_feature: GZ8MTXP02F4TDD.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcaccatctcttgttctggaggcacctccaacatcgggcgtgataatgtgtactggtacaagcaggtcccaggaaccgacccccaaatccctacatctctacaacaaataatcaacgccgaccccctcgacggactcccctgaaccgtattcctctcgtccctaccgaacggtcccggacctaccctcaaccgtcccctcccgtcggccctatccgacgggttcgggcccggttcccgggggacccgagggtacgtcgggaacgggtccttaggtaactttaagttaccgtggtacggacgagggtagtggggtatacggtaaacctaacccggttgggggtcttaccgtttaacgttccgtttaccgttacccggggtaacccggttacgggggaaaccccgttaacgggtacccgtaacccggttccgtttacgggtacccgaccggtaaacccccggg

SEQ ID NO: 335811 - DNA, 577 bp, Homo sapiens
  misc_feature: GZ8MTXP02I5Z0K.2.49.E05.1.454.CMB.2.raw
  modified_base (219)..(219): a, c, t, g, unknown or other
  misc_feature (219)..(219): n is a, c, g, or t
  modified_base (368)..(368): a, c, t, g, unknown or other
  misc_feature (368)..(368): n is a, c, g, or t
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggnagagggtcaccatctcttgttctggaagcatgtccaacatcggaagtgataatgtatactggtaccagcagttcccaagacgccggcccccaagcctcctcatctaatagaaattatgaaccggtcctcgaggggtcccctgacccgtnttcgtctggcctccgaagtctggccacctcacgccctcccgtgcccatccgagtcgggcctccgggtccgaggtntacggaggtcgtagtactttattacgttgtggttaggagtggggaacnggcacgtcctaggacgtgtcgtttagtcgttcgtttacggaaacgttcgggaaccctacggtaccgacccgttccgtacggtaccg

SEQ ID NO: 335812 - DNA, 696 bp, Homo sapiens
  misc_feature: GZ8MTXP02JHVYW.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggagggtcaccatctcttgttctggaagcatgtccaacatcggaagtgataatgtatactggtaccagcagttcccaagacgccggacccccaagcctcctcatctaataagtaaattatacggaaccccggtcctacggaacggggtcccctaggaaccgtactttccgtcgtcgggccttacccgaaagttccgtcgggaccctaacccttcgaaccggtccccctccccgtgggcccctagttcccgaacgggttcggggcccttcccgggggtacccgaagggtacgttcggaacgggtccttaggtaatttaacgttacgttggttaggttagggagttacgggggaacctaggccgtaacggtcccgttagggtacggttcgtacctttagttccggttaccgtttaccgggaaacgttcggggaaccccgtacggggttacccacccggtttaccgtaacgggtaccccg

SEQ ID NO: 335813 - DNA, 566 bp, Homo sapiens
  misc_feature: GZ8MTXP02HHX2E.2.49.E05.1.454.CMB.2.raw
  modified_base (495)..(495): a, c, t, g, unknown or other
  misc_feature (495)..(495): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctccaccctcctcactcactgtgcagggtcctgggcccagtctgtgctgactcagcccaccctcagcgtctcggtacccccgggcaggagggtcaccatctcttgttctggaagcatgtaccaacatcggaagtgataatgtatactggtaccagcagttcccaaagacgccggacccccaagcctccctcatctaataagtaaaattatgaaacccggtcctacgacggggtcccctaggacccgtattcctctgggacctaccgtaaagtctgggcccacctcaacgccctcccgtgcccatcagtcgggcctccggtccgaggatggaggtctagatttatatgtgtggatggganagcacgctgagtgtcttacgtcgttcgttacgtaacgtacggtaccgacgtacgtaccgtaccgtacgtcg

SEQ ID NO: 335814 - DNA, 642 bp, Homo sapiens
  misc_feature: GZ8MTXP02HYWK8.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcaggaggtcaccatctcttgtctggaagcatgtccaaacatcggaagtgaataatgtatacgtggtaccagctacgttccccaagacgccggcccccaagcctcctcatctaatagtaaattatagaacccggtcctcgacggggtccctgaccgtatttctcgtggtcctaccgtaagtccgtggccctaccctcaccgcccttcccgtcggccctatccgtaggtcggggcccttcccgggtccgagggtactggacggtctaggtaatttacgttacgtggtgtttgggagttcggggacaggtcacggtccgttaggacgttggtacctttaagtcggtttaccgttaccggggtaaaaccgttccgggggtaaccctaccggggttccccgaaccccgggtttccttaacggggtccccg

SEQ ID NO: 335815 - DNA, 628 bp, Homo sapiens
  misc_feature: GZ8MTXP02H85MQ.2.49.E05.1.454.CMB.2.raw
  modified_base (152)..(152): a, c, t, g, unknown or other
  misc_feature (152)..(152): n is a, c, g, or t
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (503)..(503): a, c, t, g, unknown or other
  misc_feature (503)..(503): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcnctgtgcagggtcctgggcccagtctgtgctgactcagcccaccctcagcgtctcgggtacccccgggnaggagggtcaccatctcttgtctggaancatgtccaacatcggaagtgataatgtatactggtaccagcagttcccaagacgccggccccaagctcctcatctataagaaattatgaaccggtcctcgaggggtccctgaccgtattctcgtcgctcaagtctcggccaccctcacgtccctcccgtcggccctacttcgaaggttcggggcccgttccgggtaccggagggacttggagggtctagtacgtttattacgtggttggttaggaagttgggganacgcgacggtcccttggtaagtcggtacttttaagtcggttttaccgttacggggtaaaaccgttcgggggtaaccccgtaccggggttaccaacccccgggtttcgttaaccggggttaacccg

SEQ ID NO: 335816 - DNA, 682 bp, Homo sapiens
  misc_feature: GZ8MTXP02FI5PO.2.49.E05.1.454.CMB.2.raw
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
  modified_base (590)..(590): a, c, t, g, unknown or other
  misc_feature (590)..(590): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggcaggacgggtcaccattcttcttgttcgtaggaagcatcgtaccaaacagtacggaagtgaataagtgtaacttacgtacggtaaccagacgtacgttaccccgaaacggacggccccggaccccccaaagcccttcctaccactacgttaataaagtaaatttagtacggaaccccggttccctacggacggggtcccctagacccgtatttccncgtcgggcctacccgaagttcgtcgggaccctaccctcgaccgtccccttccccgtacggaccctacncgtacgggtcggggtccgtcccgggtccggaagggtatgggacggtcgtagttaatttagttacgttggttaggttggaggtcgggaacncgacgacgcgtgtacggtgtacttagttcgtccgtttacggaacggtcggtaacccgtaccggtaccgtacccggtaccgtacggtaacccg

SEQ ID NO: 335817 - DNA, 564 bp, Homo sapiens
  misc_feature: GZ8MTXP02HE67O.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgtctggaagcatgtccaacatcggaagtgaataatgtatactggtaccagcacgttcccaagacgccggacccccaagcctcctacatctaataagtaaaattataggaacccgtcctcgacggggtcccctgacccgtattctctggcctccaagtctggcacctcacgccctcccgtgcccatcgaggtcgggcctcccgggtccgaaggctaggacggtctaggtatttaagttactggttgttaggagtgggacagcagccgtgagtgacttagtcgtcgttacggaacgtcgggacctacggtccaccggtcgtaacggccg

SEQ ID NO: 335818 - DNA, 583 bp, Homo sapiens
  misc_feature: GZ8MTXP02I4GQ5.2.49.E05.1.454.CMB.2.raw
  modified_base (508)..(508): a, c, t, g, unknown or other
  misc_feature (508)..(508): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggagaggtcacatctcttgtctggaagcatgtccaacatcggaagtgataatgtatactggtaccagcacgttacccaagacgccggacccccaagcctcctcatctaataacgtaaattagtacgaacccggtcctacgacggggtcccctggacccgtattccgtctggtcctaccgaagttcagcctaaccctcgacgccctcccgtcggccctacgtccgaggtcgggtccgtcccgggtccgagggactggacggtctagtatttatacgtggttgtggagtgggacngcacgtccgtagacgtgtacttagtcgttcgtacggaacgtcgggaccgtacggtccaccggttccgtagtaccg

SEQ ID NO: 335819 - DNA, 518 bp, Homo sapiens
  misc_feature: GZ8MTXP02IZIEP.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttcccaagagcggcccccaagctcctcatctatagaaattatgaaccgtcctcgaggggtccctgaccgattctctggctccaagtctggcacctcacgcctccctggcccatcagtgggctccggtccgaggactgagctgattatactgtgttggatgggacagcagcctgagtgcttagtcgtcgttacgaacgtcgggacctacggtcaccgtccgtaggtaccg

SEQ ID NO: 335820 - DNA, 738 bp, Homo sapiens
  misc_feature: GZ8MTXP02HS8KM.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcaggagggtcaccatctcttgttctggaagcatgtccaacatcggaagtgataatgtatactggtacagcagttcccaagacgccggacccccaagcctccctcatctatacgaaattatgaaccgtcctcgaggggtcccctgaacccgtattcctcgtcggtcctccgaacgttcgtgggacccacccttcacggtccctccccgtcgggtccccaagttcccgaagggttcgggggacccttccccgggggttaccccgggaaggggtacgttacgggaacgggttccgttacggtaattttaacgtttaaaccgttgggtttaagggtttcgggggtaaacggtttggggggtaaaccctaaaggtccccgaaagggtacccccggttttgggaaacccggtttggggttaccctttaaagtttcgggttacccgttttacggggaaaacccggttcgggggaaaccccgtaccgggggttacctaccccggtaccgtttacggggttaaccccgg

SEQ ID NO: 335821 - DNA, 673 bp, Homo sapiens
  misc_feature: GZ8MTXP02IXIMK.2.49.E05.1.454.CMB.2.raw
  modified_base (216)..(216): a, c, t, g, unknown or other
  misc_feature (216)..(216): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccggnagaggtcaccatctcttgttctggaagcatgtaccaacatcggaagtgataatgtatactggtaccagcagttcccaagacgccggacccccaagcctcctcatctaataagaaattatagaacccgtcctcgacggggtccctgaccgtattcgtctacggcctccaaagttctacgggcctaaccctcgaccgtccctcccgtcggaccctaattcccgaaggttcgggggcccttcccggggttccggaaagggtacttagggaacgggtccttaggtaattttaacttaacgtttggttggtttgggaaagttcgggggtaactaacggcgtaacggtcccgtttaggaacggtttgtaccgtttaagttacggtttccgttacggggaaaaccgttcgggggaacccctacgggggtacccctaaccccgggttccgttaacgggtaccccg

SEQ ID NO: 335822 - DNA, 580 bp, Homo sapiens
  misc_feature: GZ8MTXP02J1Z47.2.49.E05.1.454.CMB.2.raw
  modified_base (396)..(396): a, c, t, g, unknown or other
  misc_feature (396)..(396): n is a, c, g, or t
  modified_base (488)..(488): a, c, t, g, unknown or other
  misc_feature (488)..(488): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccggggaggcttagttcagccgtggggggtccctgagactctcctgtgcagcctctggattcaccttcagtcgctactggatgcactcggttccgccaagttccgaggggaaggggctggaggtgggtctcgacgcagttgatccatccgtgggaataggattaacgacgcggcctcgtggacggggccattcacntctcagacgacaacgccaggaccactctgtatcgtagaaatgaagctagtctacgagacgggacgaggaccacggtcttagtttaattacgngtacgaacgtaaggtcgtaacggtccgggttacgggggaactaacggtacggtacgttaccggtacgggggtccaacgggggtcttaacggg

SEQ ID NO: 335823 - DNA, 605 bp, Homo sapiens
  misc_feature: GZ8MTXP02GU6O2.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccgggnaggaggtcaccatctcttgttctggaagcatgtccaacatcggaagtgataatgtatactggtaccagcacgttcccaagacgccggcccccaagcctcctcatctaataagtaaattagtagaacccgtcctcgacggggtccctagaccgtattctctcggcctaccgaagtctcgggaccaccctcaccgtcccctcccgtcggcccatccgagggttcgggcccgtcccgggtaccggaagggtagtaggacgggtctaggtaatttacttacgttggttaggttggagtggggacagcgacgtccgtagacgtgtacttagttcgtacgttacggaacgtcggggaacccgtacggtccgaccggttccgtacggtaccg

SEQ ID NO: 335824 - DNA, 572 bp, Homo sapiens
  misc_feature: GZ8MTXP02JHI6L.2.49.E05.1.454.CMB.2.raw
  modified_base (218)..(218): a, c, t, g, unknown or other
  misc_feature (218)..(218): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (480)..(480): a, c, t, g, unknown or other
  misc_feature (480)..(480): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgagcccagtctgtgctgactcacgccaccctcagcgtctcggtacccccggnagaggtcaccatctcttgttctggaagcatgtccaacatcggaagtgataatgtatacgtggtaccagcacgttcccaagcgccgaccccaagcctcctnatctatagaaattnacgacgtcctacgacgggtccngacgtnttctcgtcggcctaccgagtctggccacctcacgccctccngccactcgaggtcggccgttccgggtccgaggtgtcggaggtctaggtatttagttacgtggtggttggagtgggaacnggcgaggtcctaggagttcgtacgtttagtcgttacgttaacgggaacgttccggggaaacccacggttaccccgtaccggtaccgtaacgg

SEQ ID NO: 335825 - DNA, 583 bp, Homo sapiens
  misc_feature: GZ8MTXP02HVEFN.2.49.E05.1.454.CMB.2.raw
  modified_base (219)..(219): a, c, t, g, unknown or other
  misc_feature (219)..(219): n is a, c, g, or t
  modified_base (358)..(358): a, c, t, g, unknown or other
  misc_feature (358)..(358): n is a, c, g, or t
  modified_base (436)..(436): a, c, t, g, unknown or other
  misc_feature (436)..(436): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctggtaccccccgggnagagggtcaccatctcttgttctggaagcatgtccaaacatcggaagtgataatgtatactggtaccagcagttcccaagagccggcccccaagcctcctcatctatagaaattatgaacccgtcctcgaggggtcccngaccgattctctggcctccaagtctggccacctcacgtccctcctggcccatcaggtcgggccttcccggtccgaggntggaggtctaggtatttattacgtggttgttgggagttggggacagaccgagcccgttggagtgtcctttagtcgttacgttaccgggtaaacgtcggggtaaccccgtaccgggtccgtacccggttcccgtttacggggtacccg

SEQ ID NO: 335826 - DNA, 670 bp, Homo sapiens
  misc_feature: GZ8MTXP02HDE1W.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtcctcggtaccccccgggnaggaggtcaccatctcttgtctggaagcatgtaccaacagtcggaagtgaataagtgtatactggtaccagcacgttaccaagacgccggacccccaagcctcctcatactataaataaaattactaggaaacccggtcctacgtacggggtcccctaggacccgtatttcctcgtggccctaccgaagtccgtggccctaaccctcaccgtcccctcccgtcggaccctagtccgtacggtcggggccttcccgggtccggaaggatcggacggtacgtgttaaatttagttacgttggttggttaggaggttacgggacgaggcgtaacggtccgttaggtagttcgttaccgtttagtacgggtttacccgttacggggtaaccggtaccggggtaaccccgtaccgggttaccccgtacccggttacccggtaaacggtccccgg

SEQ ID NO: 335827 - DNA, 755 bp, Homo sapiens
  misc_feature: GZ8MTXP02JCT4H.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnaggacggtcacatcttcttgttcgtaggaagctatcgtaccaacagtacggaagtagtaataatagtaatacgtacggtaaccagactacgtaccgaagaccggcccggacccccaacgtcctcctactacttactaataaagtaaattagtacggtaaccccgtcctacggtacggggtccctacgaccgttacttctcgtcggtcctaccgtaagttccgtacggaccctacccgtaccgaccgtccccgtcccgtcggtaccctacgtccggtacgggtccggggtcccggttaccccggggtaccggtaacgggtacggtacgggacggttcgttagttacgttttaacgtttacggttggtttagggttacggggtacggttacggggaacgtacgggtacgtacggtccggttaggtacggttacgttacgtttacgttaccggttaccggtttaaccgggtaaccggttaccggggtaacccggtaccgggttacccgtaacccggtttaccggttaaccggtacccg

SEQ ID NO: 335828 - DNA, 537 bp, Homo sapiens
  misc_feature: GZ8MTXP02IS74E.2.49.E05.1.454.CMB.2.raw
  modified_base (218)..(218): a, c, t, g, unknown or other
  misc_feature (218)..(218): n is a, c, g, or t
  modified_base (453)..(453): a, c, t, g, unknown or other
  misc_feature (453)..(453): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatgtccaacatcggaagtgataatgtatactggtaccagcagttccccaagagccggcccccaagcctcctcatctatagaaattatagaaccgtcctgacggggtccctgaccgattctctgctccaagtctggcacctcacgccctcctggccatcagtcgggctccggtcgacggatggaggtctgattatacgtgtgttggntgggacagcagccgttgacgtgctttagtcgttacgttcggaacgttcggggacccacggtccacccggtcgttacggtacccg

SEQ ID NO: 335829 - DNA, 632 bp, Homo sapiens
  misc_feature: GZ8MTXP02IPDS9.2.49.E05.1.454.CMB.2.raw
tcagacgctcgacacacgaccggtgctcgatttagagcgactagcaacacacaaagggggccccagccctgggattcccagctgtttctgcttgctgatcaggactgcacacagagaactcaccatggagtttgggctgagcgtggtttctgtgctatttaaaggtgtcagtgcgaggtgctgctggtggaggtccgggggagcttagttcagccgtggggggtccctgagactctcctgtgcagcctctggattcaccttcagtcgctacgtggatgcactggtcccgctaagttccgaggggagggctgggagtgggtctcgacgctagttgactccatccgtaggggaaattagggaactttaacgtaccggccggtcccgttaccgggtggaacgggggcccagtttccacctatcctccgagaacgaaccgaacgacccgaaggaacctactactagtactcgttagggaaatggaacgtcacggttcacggaggacgggcggaaggacgaacggtcgttaggtttacttacgtgtaccaacgtaaaggtcggtaacgggttccgggttagggggacgtaacgttcggaaacgttcgggtcgggggacccgggtacgggtacgtagg

SEQ ID NO: 335830 - DNA, 794 bp, Homo sapiens
  misc_feature: GZ8MTXP02HD6EY.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnaggagggtcaccatctcttgttctggaagcatgtaccaacagtcggaagtgataatgtatactggtaccagcacgttcccaagacgccggacccccaagcctcctacatcctaataaagtaaattagtacggaaaccccggttccctacggtaacggggttcccctacggtaaccccgtatttcccgtccgtcgggtacccttacccgtaaaggtttcccgttacggggaccctaaacccccgttcgaacccggtccccctttcccccgttcgggacccctacgtacccggaacggggttccggggtaccccgttccccgggggttcccgggaaaaggggtcgtttacggggaacgggtttccgttaggggttaatttttaaccgtttaaccggttggggtttacggggtttacgggggtaaacgttggggggtaaaacccgtaccgggtaccgtacgggtccggttagggtacggttacgttacgtttacggttcggttaccggtttaccgggtaaccggttccgggtaacccgtaccgggttacccgtacccggttaccggtaccggtaccg

SEQ ID NO: 335831 - DNA, 594 bp, Homo sapiens
  misc_feature: GZ8MTXP02HORAX.2.49.E05.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccggnagaggtcacatctcttgtctggancatgtccaacatcggaagtgataatgtatactggtaccagcagttcccaagacgcccggacccccaagcctccctcatctaataagaaattagtagaacccggtccctacgacgggggttcccctggaacccgtatttcctcgtggccttacccgaagttcctaggcccaccctccacgtcccctcccgtggacccagtccgaggtcgggccgtcccgggtccgaggagtggacgggtctagtatttaacttcgtggtaggttggagtgggacgagcgtagccgtagacgttgtcttagtcgttccgttacggaacgttcgggacctacggtcctaccggtcttaacggccg

SEQ ID NO: 335832 - DNA, 567 bp, Homo sapiens
  misc_feature: GZ8MTXP02IASXZ.2.49.E05.1.454.CMB.2.raw
  modified_base (219)..(219): a, c, t, g, unknown or other
  misc_feature (219)..(219): n is a, c, g, or t
  modified_base (340)..(340): a, c, t, g, unknown or other
  misc_feature (340)..(340): n is a, c, g, or t
  modified_base (513)..(513): a, c, t, g, unknown or other
  misc_feature (513)..(513): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctcggtacccccgggnagaggtcaccatctcttgtctggaagcatgtccaacatcggaagtgataatgtatactggtaccagcagttcccaagacgccggaccccccaagcctccctcatctaataagaaaatttanacgaacccggtcctacgacgggtccctgacccgtattctcgtggcctccaagtcgtgccaccctcacgccctcccgtcggcccagtcgaggtcgggccgttcccgggtccggagggagtggagggtctggtattaagtttacgtggttagttggagttgggacagcagcctgngtgcttacgtgtcgttaggaacgtggaccacggtaccaccggtcgtaggtaccg

SEQ ID NO: 335833 - DNA, 655 bp, Homo sapiens
  misc_feature: GZ8MTXP02G4LNK.2.49.E05.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggnagaggtcacatctcttgtcnggancatcgacangtacggagtnatatgtatacgtgtaccagctacgtaccaagacgcccgaccccaagcctcctactatactaataaagtaaattagtacggaaccccggtcctacggtacggggtccctacggtaccgtacttcgtcgtcggtcctaccgtaagtcgtcgacctacctcgaccgtccctcccgtcggccctacgtcgtacggtccgggtccgtcccgggtacgaaggtacgtacggacggtctagttaatttaacgttacgttggttaggttaggtaggtacgggacgtacgtaccgtacggtcgtaggtacggttcgttacgtttacgttacggttaccgttacgggtaaccgtacggggtaacccgtaccggttcccgtaacccggttaccgtaacggtaccg

SEQ ID NO: 335834 - DNA, 611 bp, Homo sapiens
  misc_feature: GZ8MTXP02H35A9.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggagagggtcaccatctcttgttctggaagcatgtccaacatcggaagtgataatgtatactggtaccagcacgttcccaagacgcccggacccccaagcctcctacattctataagaaattatgaacccggtcctcgacggggtccctgaccgtattctctggtcctaccaagtctggaccacctcacgtccctccctggccctagtcgaggtcgggccgtccgggtccgaggatcggaggtctaggtattacgttacgtggttggtttgggagttaggggactacgcgtacggtccgttagggagttcgtactttagtcggtttaccgttacggggtaaccgtcgggggtaacccctacggggttaccgaccccggttacgttacggtacccg

SEQ ID NO: 335835 - DNA, 672 bp, Homo sapiens
  misc_feature: GZ8MTXP02IRDER.2.49.E05.1.454.CMB.2.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (241)..(242): a, c, t, g, unknown or other
  misc_feature (241)..(242): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagacggtcacntctnttgtcngannatgacangcgatnatatntatactgtacagcacgtaccaagcgccgaccccagtcctcctacactactaagtaagtaaattacgtacggaccccgtcctacggtacgggtcctacggtaccgtattccgtcgtcgtacctaccgaagtcgtacgaccctaccgtcaccgtcccctccgtcggaccctacgtcgtacgggtccgggtcccgtacccggggtaccggaagggtacgtagggaacggttcttaggtaacgttttaacgttacgttggttagggttacggaaggttacggggaactaggaccgtacggtccgtaggtacgttcgttacgtttacgttcggttaccggttaaccggggtaaaccgttccgggggtaacccgttacccgggttacccgtaccccggttaccggttaaccggtaccg

SEQ ID NO: 335836 - DNA, 573 bp, Homo sapiens
  misc_feature: GZ8MTXP02G28GA.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagccgtctcggtaccccccgggnaggagggtcaccatctcttgttctggaagcatgtaccaacatcggaagtgaataatgtatactggtaccagcacgttacccaagacgcccggacccccaagcctcctcatctaataagtaaaattatagaacccgtcctacgacggggtccctgacccgtattcctctggcctacaagtctgccacctcacgccctcccgtggcccatccaggtcgggcctcccgggtccgaggacgtggaggtctagtattattacgtggtggttgggtggacagcgagccgtagagtcgtcttacgtcgtcgttacggaacgtgggaccacgggtcaccggtccgtaacggtcaaccgg

SEQ ID NO: 335837 - DNA, 582 bp, Homo sapiens
  misc_feature: GZ8MTXP02F5AKA.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcagttcccaagacgccggcccccaagcctcctcatctaatagaaaattatgaacccggtcctcgacggggtcccctggaccgtattcctcgtggcctccgaagtctcggccaccctcacgccctccctggacccatccaggtcggggcctcccgggtccgaggacgtggaggctgtatttagttacgttggtgttgggagtggggtacaggcacggccgtggagttcgtctttagtcggttcgttacgggaacgttcgggaccgtacggtcctacccggtaccgtacggtaccg

SEQ ID NO: 335838 - DNA, 703 bp, Homo sapiens
  misc_feature: GZ8MTXP02HEOFW.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagagggtcaccatctcttgttctggaagcatgtccaacatcggaagtgataatgtatactggtaccagcacgttacccaagacgcccggacccccaagcctcctcatactataagtaaattatacgaacccggtcctcgacggggtccctagacccgtattcctcgtggcctaccgaacgttcgtcgggcctacccgtcaccggtcccctccccgtggcccctagtccgaggttcgggaccgttcccgggttaccggaaggtacgttacgggacgggttccgttaggtaattttaacgttaaccgttgggtttacggtttaggggtaaggtttacgggggaaccgtaaacggccgtaaacgggtcccgttagggtaaacggtttcggtaaccgtttaacgttcggttcccgtttaccggggaaaccgttcgggggaaccccgttacgggtacccgtaccccggtacccggtttaaggtaaccccg

SEQ ID NO: 335839 - DNA, 679 bp, Homo sapiens
  misc_feature: GZ8MTXP02G3VZH.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggnaggacggtcacatctcttgttcgtaggaagctatcgtaccaacagtacggaagtagaataagtgtatacgtggtaccagctacgtaccgaaggacgcccggaccccaagcctcctactatactaataagtaaattagtacggtaaccccgttccgtacggtaccggggtccctagtaccgtattccgtcgtcggtcctaccgtagtcgtcgacctacctcgaccgtccctcccgcgaccctagtccgacggtccgggtccgtccgggtaccggaggtacgtacggacggtcttaggtaactttacgttacgttggttacggttaggtacggtacgggaacgtacgtaccgtacggtccgtaggtacgttcgttacgtttacgttccggttaccgtttaaccgggaacggttaccgggaacccggtaccgggtacccgtacccggttaccggtacggtaccg

SEQ ID NO: 335840 - DNA, 606 bp, Homo sapiens
  misc_feature: GZ8MTXP02GB1ML.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccggnagaggtcaccatctcttgttctggaagcatgtacccaacagtacggaagtgataatgtatactggtaccagcacgttcccaagacgccggcccccaagcctcctcatctaataagtaaattatagaacccggtcctcgacggggtccctagacccgtattcctcgtcggcctacccaagttcctcgggccctaccctcacgtcccctcccgtggaccctacgtcgtaggtcggggcctcccgggtaccgagggtatggacggtctaggtaatttacttacgtgttggttggagtggacagcgacgtccgtagagtcgtacgtttagtcggttccgttacggaacgttcgggaaccctacgggtacctaccggtccgtacggtacccg

SEQ ID NO: 335841 - DNA, 559 bp, Homo sapiens
  misc_feature: GZ8MTXP02IDKFF.2.49.E05.1.454.CMB.2.raw
  modified_base (337)..(337): a, c, t, g, unknown or other
  misc_feature (337)..(337): n is a, c, g, or t
  modified_base (395)..(395): a, c, t, g, unknown or other
  misc_feature (395)..(395): n is a, c, g, or t
tcagacgctcgacacacgaccggtgctcgatttagagcgactagcaacacacaaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcagttcccaagacgccggcccccaagcctcctcatctataagaaattangaacccgtcctcgacggggtccctgaccgtattctctggctaccaagtctggcacctnacgccctccgtggccctatccaggtcggctcccgggtcgaggacgtgaggtctaggtatttagttacgttggtgtttggacgttgggacagcgagcctgagtgctttagtcgttcgttacggaacgtcgggaacctacgggtacacccggttcgtacggtaccg

SEQ ID NO: 335842 - DNA, 732 bp, Homo sapiens
  misc_feature: GZ8MTXP02J0F9X.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccggcaggaggtcaccatctcttgttctggaagcatgtaccaacatcggaagtgaataatgtatactggtaccagcacgttacccaagacgcccggacccccaagcctccctcattactaataaagaaattagtacggaacccggttcccgtacgtacgggggttcccctacggaacccgtagtttcctcgtcgggtccctaccgaacgtccgtggaccctacccgtccacgtccccctcccgtcggccctatccgaggtcggggtccctcccggggtacccggagggtacgtcgggacggtccttaggtaacgttttaacgttacgtttgggtttagggtttaggggtaaggttcgggggaactacggaccgtacggtacccggttgggtaacggttcggttaccgttttaacgtttcgggtttaccggtttaaaccggggaaaccggttccgggggaaaccccggttacccggggttacccgtacccgggtttaccccgttaacggggtaaccccg

SEQ ID NO: 335843 - DNA, 601 bp, Homo sapiens
  misc_feature: GZ8MTXP02INLAR.2.49.E05.1.454.CMB.2.raw
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcggtaccccgggnaggaggtcaccatctcttgtctggaagcatgtccaaacntacggaagtgataatgtatactggtaccagcacgttcccaagcgccggaccccccaagcctcctacactactaataaagtaaattatacggaacccgtcctacgtaggggtcccctagacccgtattccgtcgttggccttaccgaagtcgtcggcctaacccttcgaccgtccctccgtcggccctagtcaacggttcgggcccttcccgggtccgaggtactggaggtctaggtactttatacgttgtggttggagtgggacagcgacgctggagtggtcttagtcgttacgtacggtaacgtcggggaccctacggtccaccggttacgttaacggcccg

SEQ ID NO: 335844 - DNA, 563 bp, Homo sapiens
  misc_feature: GZ8MTXP02ISTHU.2.49.E05.1.454.CMB.2.raw
  modified_base (484)..(484): a, c, t, g, unknown or other
  misc_feature (484)..(484): n is a, c, g, or t
tcagacgctcgacacacgaccggtgctcgatttagagcgactagcaacacacaaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggaagtgataatgtatactggtaccagctagtcccaaagacggcccggacccccaagcctcctcatctatagaaattatgaacccgtcctcgacggggtccctgaccgtattctctggcctaccaagtctggccacctcacgccctccgtggcccatcgaggtcgggcctccggtcgaggagtggaggtctaggtattacttacgtgttgtggagtggggacngcgtacgccgtaggagttcgtactttacgtcgttccgttcggaacgtcgggacctacggtcacccgttcgtacggtccg

SEQ ID NO: 335845 - DNA, 564 bp, Homo sapiens
  misc_feature: GZ8MTXP02HTPCD.2.49.E05.1.454.CMB.2.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctggtacctcccgggnagaggtcaccatctcttgtctggaancatgtcaacatcggaagtgataatgtatacgtggtaccagcacgttacccaagacgccggaccccaagcctcctcatctatagaaattatacgaacgtcctacgacggggtccctgaccgnttcgtctggcctacgaagtctcggcctacctcacgtccctcccgtcggccctactcgacggtcgggcctcccgggtaccgaggtatggacggtctaggactttattacgtgtggttggagtgggacagcagtcctaggcgttcgtacttagtcgttcgttaacggaacgtcgggtaccacggtccaaccgttcgtacgg

SEQ ID NO: 335846 - DNA, 768 bp, Homo sapiens
  misc_feature: GZ8MTXP02F3RQ7.2.49.E05.1.454.CMB.2.raw
  modified_base (198)..(198): a, c, t, g, unknown or other
  misc_feature (198)..(198): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctnagcgtctcgggtacccccggcagaggtcaccatctcttgttctggaagccatcgtacccaacagtacggaagtgaataatgtaatacgtggtaccagcaacgttcccaaagacgcccggacccccaagcctcctactatacttaaataacgtaaaatttacgtacggtaaaccccggttccctacggtacggggttaccccctaggaaccccgttatttccgtaccgtcgggtacccttacccgaaagttcctacgggaccctaacccgtcaacccgtcccccgttcccgtacggaccctaacgtccgtaacggggtccggggtcccgttacccggggtaccgaaagggtacgttagggaacgggttccttaggttaaacttttaagtttaccggttggtttgggtttacgggaaaggttcggggaaaccgaaggtcccgtaacggtcccgttaggtaacggttgttaccgtttaaagttccggttaccgtttaaccgggaaaaccggtttccggggaaacccgtaaccgggttcccgtaaccccggtttacccgtaagggtaacccccg

SEQ ID NO: 335847 - DNA, 567 bp, Homo sapiens
  misc_feature: GZ8MTXP02FHN45.2.49.E05.1.454.CMB.2.raw
  modified_base (368)..(368): a, c, t, g, unknown or other
  misc_feature (368)..(368): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtacagcagtcccaagagccggcccccaagcctcctcatctatagaaattatgaacccggtcctcgaggggtcccctgacccgattccnctggctccaagtctggccacctcacgccctcccgtggccctatccgaggtcggggccttcccggggtcccgaagggacttggacgggtcctggtaatttaattaccgtggttaggttgggagttggggacaggcaggtcctggagtgcttagtcgtcgttcggaacgtgggacccacgggtccacccggtcctaggacc

SEQ ID NO: 335848 - DNA, 704 bp, Homo sapiens
  misc_feature: GZ8MTXP02G4S2Q.2.49.E05.1.454.CMB.2.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (332)..(332): a, c, t, g, unknown or other
  misc_feature (332)..(332): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtccgtgggcccagtctgtgctgactcacgcccaccctcagcgtcgtcggtaccccggnagaggtcacatctcttgtctaggaancatcgtaccaacagtacggaagtgaataatgtatacgtggtaaccagactacgtccaaaggcgcccggacccccaagtcctccctntatactaataaagtaaaatttacgtacggtaaccccgtcccgtacgtaaccggggtcccctaggaccgttactttccgtccgtcggaccttacccgaagttcctcggaccctaaccctcgaaccgtccccgtccccgtcggaccctactccggacggtccggggtcccgtccccgggtaccggaggacgtggacggttcgtagttaatttaacgttacgttggttaggtttagggagttacggggacctaggaccgacggtcccgttaggtacggttcgttaccgtttagttcggttccgtttaaccggggaacgttaccgggggacccgtacccgggttaccgtaccccggttaccgttaacgggaccccg

SEQ ID NO: 335849 - DNA, 740 bp, Homo sapiens
  misc_feature: GZ8MTXP02JE2G8.2.49.E05.1.454.CMB.2.raw
  modified_base (226)..(226): a, c, t, g, unknown or other
  misc_feature (226)..(226): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcgagggtcctgggcccagtctgtgctgactcacgcccaccctcagccgtcgtccgggtacccccgggnaggagggtccaaccattccttcgtttgttcgtaggaacgctatcgtaccaacagtacggaagtgaataatgtatacgtaggtaaccagactacgtacccaaaggacggcccggacccccaagccctccctactatacttaataaagtaaattagtacggtaaccccggtcctacggaccggggtcccctaggaacccgttactttccgtcgttcggaccctacccgtaaacgttcgtcgggaccctacccttacacccgtcccctcccgtcggcccagtccgagggtcggcccgttcccggggtaccgagggtacgtcgggacgtacgttagttaatttacgtttaaggttggtttcggggtttaggacggttacggggaacgtacggacccgttaggtcccgttagggtaacggttcgttacgtttacgttacgggtttccgtaaccggggtaaccgttaccggggaaccccgttaccggtacccgtacccggttaccgttaacggtaccccg

SEQ ID NO: 335850 - DNA, 556 bp, Homo sapiens
  misc_feature: GZ8MTXP02JF1TE.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggnagagggtcaccatctcttgtctggaagcatgtccaacatcggaagtgataatgtatactggtaccagcagttccaaagagcggcccccaagctcctcatctatagaaattatgaaccggtcctcgacggggtccctgacccgattctctggctccaagtctggcacctcagccctccgtgcccatccgaggtcgggcctccgggtccgacgggatggaggctaggtattagttactggtgttggagttgggactagcgtaacgccgtggacgtggactttagtcgttcttacgggaacgtcgggacccgtacggtccgtaccgtccgtacggtacccg

SEQ ID NO: 335851 - DNA, 611 bp, Homo sapiens
  misc_feature: GZ8MTXP02JE37U.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagacgggtcaccatctcttgttctggaagcatgtccaacatcggaagtgataatgtatactggtaccagcagtccaagacgccggcccccaagcctcctcatctaatagtaaattataggaacccgtcctacgacggggtccctaggaccgtattccgtcgtcggtcctaccaagttcgtcgggcctaccctcgacgtccctcccgtggcccagtcgacggtcgggccgtccgggtccgagggatcggacggtctagtatttattacgtggttaggttggagtcggggacaggcgacggtccgtaggacggttgtaccgtttagtcggttccgttaaccgggaacgttcggggaacccgtacgggttccacccggtttccgtacgggtacccg

SEQ ID NO: 335852 - DNA, 676 bp, Homo sapiens
  misc_feature: GZ8MTXP02F4CN7.2.49.E05.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggagggtcaccatctcttgttcnggaancatcgtaccaacatacggaagtgaataatgtaatactggtaccagctacgttacccaagacgccgacccccaagcctccctcactctaataaagtaaattatagtaaccccgtcctcggtacggggttcccctagtaacccgtattccgtacgtcgggtacctacccgaagttccgtcgggccctaccctacgaccgtccccttcccgtcggacccatccgagggtcgggtccgtcccgggtccggaaggtacgtgggaacggtcttaggtattttacgttacgttggtttggttagggtacgtagggggaaccgtacggacgtacggtacgtaggtacgttcgtacgtttcgttcggttaccggttacggggtaacggttaccggggaccgtacccgggtacccgtacccggtaccgtacggtaccg

SEQ ID NO: 335853 - DNA, 767 bp, Homo sapiens
  misc_feature: GZ8MTXP02IVPRL.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggnagagggtcaccatcttcttgttctggaagcatcgtaccaacatacggaagtgaataatgtatactggtaccagctagtcccaaagcgcccggaccccccaagcctcctacactctaatagtaaaattactagaacccgttccctagacggggtccctagacccgttattcctcgtcggccttaccgaagttcgtacgggccctacccgtacaccgtcccttcccgtacgggtaccctaacgtccgtaacgggttccggggtacccgttccccggggtacccggtaaggggtacgttaggggaacgggttccgttaagggtaacttttaacgtttacgttgggtttaagggttgggggtaaacggttacgggggtaaactacgggacccgtaacggtcccggtttaaggtaaccgggtttacggtaccttttaaacgggtttccgggtttaacccgtttacccgggggtaaaaccgggttccggggaaacccccggttaaacccgggggtccctaaacccccggggtttacgttaaccggggtaccccgg

SEQ ID NO: 335854 - DNA, 754 bp, Homo sapiens
  misc_feature: GZ8MTXP02IDIMU.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagcccaccctcagccgtctcggtacccccgggaggaggtccaccatctcttgttctggaagcatgtaccaacatcggaagtgataatgtatactggtaccagcacgttaccaagacgcccggacccccaagcctacctcattctaataaacgtaaatttagtacggtaaacccggtcctaccgtacggggtcccctaggtaaccccgtatttccgtacgttcgggtcccttacccgtaaagttccgtacgggcccaacccttcgaaccgtccctccccgtcgggtccctaagttccgtacgggttccggggcccgttccccggggtacccggacggggtagttacgggaacggggttccttagggttaacttttagtttaaaccgttggggtttcgggttttagggaagggttacgggggtaacgtacgggtaccgaacgggtaccccgtttgggaaacgtttcgggtaccttttaaggtcggttttacccgttacggggtaaaaccgttcggggtaacccgtacccggtaccgttaaccccggtccggttaaacggggtacccccg

SEQ ID NO: 335855 - DNA, 708 bp, Homo sapiens
  misc_feature: GZ8MTXP02G2RT3.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagccgtcgtcggtacccccgggnaggacggtcaccatctcttgttctggaagcatgtaccaacagtcggaagtgataatgtatacgtggtaccagcacgttaccgaagacgcccggacccccaagcctcctacatctaataagtaaattagtacggaaccccggttccgtacgtacggggtccccctaggtacccgtatttccgtcgtcggtccttaccgtaagttccgtcgggaccctaccctcgacccgtccccttccccgtcggcccctagtccgtacgggttccggggtcccgtaccccggggtaccggaagggtcgttagggacggtcgttagttaacgttttacgtttacgttgggtttagggtttagggtaggttacgggggtaacgtacggacgtacggtccggttaggtacggttcgtacgtttagtcggtttccgttaacgggtaaccggtcgggaaccccgtacgggtacccgtacccggttaccggtacggtacccg

SEQ ID NO: 335856 - DNA, 710 bp, Homo sapiens
  misc_feature: GZ8MTXP02IKZBC.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtctcgggtacccccggcaggaggtcaccatctcttgttctggagcatcgtaccaacatacggaagtgaataatgtaatacgtaggtaccagctacgttaccgaagacgcccggacccccaagcctcctacatactaataagtaaattagacgtaaccccggtccgtacgtacggggtcccctggaacccgttcttcctacgtcggcccttaccgaacgttcgacggccctaccctcacccgtccctccgtcggccctagtccgtacgggtcgggtcccgttaccgggtaccggaaggtacttacgggacggtacttagtaactttagttacgtggttaggtttacggaggttacgggacaacggtcgtacggaccgttagggtacgttacggtacgtttaaacgttccggtttacccggttaaaccggggtaaccggttacgggggaacccccttaaccggggttaccccgtaaccccggtttacccggttaaacgggtaacccccg

SEQ ID NO: 335857 - DNA, 600 bp, Homo sapiens
  misc_feature: GZ8MTXP02HK077.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccgggnaggacgggtccaccatctcttgttctggaagcatgtccaacatcggagtgataatgtatactggtaccagctacgttcccaagacgccggacccccaaagcctcctcactctaataagtaaattagtagaacccggtcctacgacggggtccctgaccgtattctcgtcggctaccgaagttccgtggcccacctcacgtccctcccgtggcctatcgaggtcgggacgttcccgggtcgaggtacgtcggaacggtcgtagtagtttaacttcgtggttggtagggtagttcgggacagcgtaacgccgttagagtcgtactttagcgttacgttacggaacgttcggggacctacggtcctacccggtcgtacggtacc

SEQ ID NO: 335858 - DNA, 749 bp, Homo sapiens
  misc_feature: GZ8MTXP02J2CNR.2.49.E05.1.454.CMB.2.raw
  modified_base (246)..(246): a, c, t, g, unknown or other
  misc_feature (246)..(246): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggaggacggtcaccatcctcttgttctggaancatcgtaccaacagtcggaagtgaataatgtactacgtggtaccagctacgtcccaagcgccggacccccaagcctcctcatctaataacgtaaattgtacgaacccggtcctcggacggggttccctgaccgtattccgcgtcggtccctacgaagtcgtacggcccacccgttacgaccgtcccccgttccccgtacggaccctagtccgtaacggggttcccggggtccccgtttaccccgggggtaccggaaggggaacgttcggggaacgggtcctttaagggttaactttttaaaccgttacggttgggtttacggggttacggggtaaggtttaccgggggaaacctacgggacccgtaacggtccccggttagggtacggtttacgttccggtttacgtccggtttaccccggtttaacgggaaacccgtttccgggggaccccgttaacccgggttacccgtacccccggtttacccgggttaacggtaccccg

SEQ ID NO: 335859 - DNA, 616 bp, Homo sapiens
  misc_feature: GZ8MTXP02IWOF9.2.49.E05.1.454.CMB.2.raw
  modified_base (538)..(538): a, c, t, g, unknown or other
  misc_feature (538)..(538): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtcgtcggtacccccgggcaggagggtcaccatctcttgttctggaagcatgtccaacatcggaagtgataatgtatactggtaccagcacgttccaagacgcccggacccccaagcctcctcactctataaagtaaattagtacgtaacccggtcctacgtacggggttcccctgaacccgtattcctcgtcgggaccttacccgaagttccgtggccctacccgtcacgtccctccctggcccagtcctaggtcggggtccttacccggggtaccgaggtacgttgggacggtctacgtatttacttacgttggttcgttgggacttggggacngcacgtcctggacggtctcgtttcgtcgttccgttacggtaacgtcggaccgtacggtccaccggtcgtacggtaccg

SEQ ID NO: 335860 - DNA, 558 bp, Homo sapiens
  misc_feature: GZ8MTXP02GNPK8.2.49.E05.1.454.CMB.2.raw
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
  modified_base (542)..(542): a, c, t, g, unknown or other
  misc_feature (542)..(542): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgcttattttaaaaggtgtccagtgcgaggtgctgctggtgggaggtccgggggaggcttagttcagccgtggggggtccctgagactctcctgtgcagcctctggattccaccttcagtcgctactggatgctacgtcggtccgacctaagttccgaggggaaggggctgggagtcgggtctcgacgctattgatccatccgtagggaataggaacttaacgacgcggcctcgnggacgggccatcacatcncagagacaacgccaagacnctctagtatcgtagaaatgacgtcagtctacgaggacggacgacggacgacgtgttagtttactactgacacgtaagtcggacgtcggttagggagaaccgtagacgttacggngggaccgagggctagg

SEQ ID NO: 335861 - DNA, 739 bp, Homo sapiens
  misc_feature: GZ8MTXP02GJAEY.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggagggtcaccatctcttgttctggaagcatgtaccaacatcggaagtgataatgtatactggtaccagcacgtccaagacgccggcccccaagctcctcatctaataagtaaattagtacgaacccggtcctcgtacggggtccccctagaccccgttattccgtcgtacggccttacccgaagttccgtcgggccctaacccgttcaaccggtcccccttaccccgtgggaccccctaagttcccgaacgggggttccggggtcccttaccccgggggtaccgaaagggtacgttgggaacgggtcttacggtaattttaacgttaccgttgggtttaggttacggggaaggttcgggggaaacctgggacccgtacggtcccgttagggtaaggtttcgttacccgttttaagtcgggttttacccgtttaaacgggggtaaaacccgttccgggggaaacccgttacccggggttaccctaaaccccgggtttccggttaaacggggtacccccg

SEQ ID NO: 335862 - DNA, 760 bp, Homo sapiens
  misc_feature: GZ8MTXP02GAZE3.2.49.E05.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtctcgggtacccccggagaggtcacatctnttgtcnggancatgtcaangtcggaagtgatatgtatactggtaccagcacgtccaagcgccggacccccaagcctcctcactactaataagtaaattagtacggaaccccggtccctacggaccggggttcccctacggaacccgttatttccgtcgtcgggtacccttacccgtaaagttccgtcgggaccctaacccttccgaaccggtccccttcccccgtcgggaccctaacgtcccggtaacggggttcccggggtcccgttacccccgggggttaccggaaagggtacgttacggggaaccgggttcgttaacggttaaattttaacgtttaccgtttggggtttacgggtttacggggaaaggttcgggggaaaccgtacgggtaccggtacggtccggttagggtaacggtttcgtttaccgtttacggttacgggtttacccggttaacgggtaaccggttaccggggtaacccgttaccggggtacccgtacccggttaccggtacggtaccccg

SEQ ID NO: 335863 - DNA, 636 bp, Homo sapiens
  misc_feature: GZ8MTXP02IKX8B.2.49.E05.1.454.CMB.2.raw
  modified_base (79)..(79): a, c, t, g, unknown or other
  misc_feature (79)..(79): n is a, c, g, or t
  modified_base (219)..(219): a, c, t, g, unknown or other
  misc_feature (219)..(219): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
tcagacgctcgacacacgaccggtgctcgatttagagcgactagcaacacacgaaagggggggaagctcagcttcagcngtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgtctggaagcatgtaccaacatcggaagtgaataatgtatactggtaccagcagtccaagcgcgaccccagctcctantatatagtaaattnagaccccgtcaggcggtcctcgacgtctctcgngtcccacgtactcgtcgaccctacctcgacgtcccctccgtccggaccactccgtagggtccgggtccgttcccgggttaccgggaaggtgtacgggacgggtactgttaacgttttaagtttacgttggttagggtttacggaagggttacgggacgtagcgaacggtccgtaggtagtcggaaacttttagtcggttaccgtttcgggaaaaccgttcgggggtaaccccaccggggttcccgtaaccccgggttccttaaacggggtcccg

SEQ ID NO: 335864 - DNA, 589 bp, Homo sapiens
  misc_feature: GZ8MTXP02HRL0X.2.49.E05.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagaggtcaccatctcttgttctggaancatgtccaacagtcggaagtgaataatgtatactggtaccagcagttcccaagacgccgacccccaagcctcctnatctaataagtaaaattntagaacccgtcctcgacggggtccctgacccgtattcctcgtaggccttaccaagtcctggcccacctcacgccctcccgtcggcctactcgtacgtcgggtccgtccggtccggacggacgtgaggtccccccgtggtacttattacgttggttggttggtagtaggacgagacgacgcgtgacgtgtcttagtcgttcgttacggtaacgtacggaccgtacggtaccgtaccgtaccgtacgtaccg

SEQ ID NO: 335865 - DNA, 763 bp, Homo sapiens
  misc_feature: GZ8MTXP02FY406.2.49.E05.1.454.CMB.2.raw
  modified_base (222)..(222): a, c, t, g, unknown or other
  misc_feature (222)..(222): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggtaccccccgggnaggacggtcaccatcttcttgttctggaagcatcgtaccaacagtcggaagtgataatgtatacgtggtaccagcacgttcccaagcgccgcccccaagcctaccctcatactaataagtaaattagtacgaacccggttccctcggtacggggtcccctaggaacccgtatttccgtcgtcgggtccttacccgaaagttccgtaggccctacccttccgaccggtcccctcccgtacggccctaagtccgaagggttccggggtcccgtacccggggtccggtaaaggggtactacggggtacgggtctttacggtaagtttttaaccgttaacgttgggtttacggggtttagggtaacgggttggggtaaaccgaaggtcccgtaaaggttccccgttaaggggtaggtttaccggttacgtttttaacgtccggttttacccggtttaaccgggggtaaaccgtttaccgggggaaccccgtaaccggggttaccccgtaaccccgggtttacccggtaacggggttaacccccgg

SEQ ID NO: 335866 - DNA, 736 bp, Homo sapiens
  misc_feature: GZ8MTXP02IQFA9.2.49.E05.1.454.CMB.2.raw
  modified_base (216)..(216): a, c, t, g, unknown or other
  misc_feature (216)..(216): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccggnagaggtcaccatctcttgtctggaagctatcgtaccaactagtacggaagtagaataatgtaatacgtcggtaccagctacgttaccccgaagacgcccggaccccccaagtcctccctactatctaagtaacgtaaattagtacggaacccggtcctacgtaccggggtcccctaggacccgttatttccgtcgtcgggtcctacccgtaaagttccgtacgggtaccctacccttacgaccgtcccccgttcccgttcgggaccctacgtaccgtacggggttcggggtccccgttaccccgggttaccgggaaagggttacgttacggggaacggttccgttagtaacgttttaacgtttaaccgttggtttacgggttagggtaaggttacggggtaacacgggtaccgtaacggtcccgttagggtaacgttcgtacgtttagttcggttaccggttaccgggtaacgtacgggaacccgtacggtaccgtacccggtaccgttacggtaacccg

SEQ ID NO: 335867 - DNA, 619 bp, Homo sapiens
  misc_feature: GZ8MTXP02HOMKK.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggaggtcaccatctcttgttctggaagcatgtccaacatcggaagtgataatgtatactggtacagcagttcccaagacgccggacccccaagcctcctcactctaataagtaaattatagtaacccggtcctacgtacggggtccctgtacccgtattccgtcgtggcctaccgtaagttccgtagggcccacccttcacgtccctcccgtcggtcccatccgacgggttcgggccgttcccgggtccgagggacgttgggaacggtcttagtaatttattacgtgttaggttaggagtggggactagcgacgccgtgacgtgtacttacgtcgttccgttacgggaaccgttcggggaacccgtacgggttacccacccggttacgttacggtacccg

SEQ ID NO: 335868 - DNA, 726 bp, Homo sapiens
  misc_feature: GZ8MTXP02F5R4V.2.49.E05.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccgggnaggacggtccacctntcttcttgttcgagganctatcgtaccaacagtacggaagtagtaataagtagtatacgtacgtaccagctacgtaccgaagacgcccgaccccacgtcctacctactactactaataaagtaaattacgtacggtaaccccgtccgtacggtacgggtacctacgtaccgttacttccgtcgtacgtacctaccgtaacgttcgtacgacccacccgtccgacccgtcccctcccgtacgccctacgtccgtacgggtccgggtacccgtacccgggtacggtacgggtacgtacgggtacggttcgttagtttaacgtttaacgttacgttgggttagggttacggtaggtacgggaacgtacggtcgtacggtaccgttaggtacgttacgttacgtttacgttacggttaccggttaacgggtaaccggttacccgggtaacccgtaaccggttacccgtaacccggtttacccggtaacggtacccg

SEQ ID NO: 335869 - DNA, 708 bp, Homo sapiens
  misc_feature: GZ8MTXP02HM24S.2.49.E05.1.454.CMB.2.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcgggtaccccccgggnagagacgtccacctattccttcttgttcgtaggaacnctatcgaccaacagtacggaagtagtaataagtagtatacgtacgtaccagacgtacgttacccaaggaccgacccgaccccacgtcctacctactactactaataagtaaattagtaccggtaaccgtccgtacggtaccgggttcccgtacgtaccgtcttccgtcgtacgtcctaccgtacgtcgtcgcctacctcgaccgtccctcccgtcgacctacgtcgtacgggtccgggtcccgtccgggtaccggtaaggtacgtacggtacggtacgttagttaacgtttacgttacgttgggttaggttacgggtaggtacgggacgacggtaccggtacggtaccgtacggtacggttcgttacgtttacgttcggttaccggttaaccggtacggttaccggggtaacccgtaccgggttacccgtaccggtttaccggtaacgg

SEQ ID NO: 335870 - DNA, 791 bp, Homo sapiens
  misc_feature: GZ8MTXP02F25UM.2.49.E05.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcggtacccccgggnaggacggtcacatctcttgttcgnggaagctatcgtaccaanagtacggaagtgaataatgtatacgtcggtaccagctacgtaccgaagacgcccgacccccaagcctccacatctaataaacgaaatttagtacgtaacccggtccctacggtaacggggtccctacgaacccgttatttccgtcgtcggtcccttaccgtaacgttccgtacgggaccctaacccgtccgaccggtcccccttcccgtcggccctaacgtccgtacgggttccgggtcccgttcccggggtaccggaagggtacgttcgggaacggttccgttagttaaacgttttaacgttaccggttagggtttacgggtttaggggtaacgggttacggggaaccgtacgggacccgtaacgggttccccggttaagggtacggttacgtttaccgttttaaacgtttccgggtttacccggttttaaccgggaaaacccgggtttacccgggggtaaaccccggttaccccggggttaccccgttaacccccggggtttaccccgttaaggggttaaccccccgg

SEQ ID NO: 335871 - DNA, 706 bp, Homo sapiens
  misc_feature: GZ8MTXP02G6KAT.2.49.E05.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnaggaggtcacatctcttgtctaggaancatcgtaccaacagtacggaagtagaataatgtaatacgtacggtaccagctacgttaccaagacgcccgacccccaagtcctcctacattactaaataaagtaaattagtacgtaaccccggtcctacggtacggggtccctacggtacccgtacttccgtcgtcggtacctaccgaagtcgtcggaccctaccctaccaccgtccctcccgtcggaccctacgtccgtacgggtcgggtcccgtcccgggtaccggaaggtacgtacgggacggtcgttagttaagtttaacgttacgtggttaggttagggagtacggggaactacggacgtacggtcccgtaggtacggttcgttaccgtttacgttcggttacccggttaaccggggtaaaccggttccgggggaaccccgtacccggggtacccgtaacccccggttaccggtaacggtacccg

SEQ ID NO: 335872 - DNA, 687 bp, Homo sapiens
  misc_feature: GZ8MTXP02I1D2S.2.49.E05.1.454.CMB.2.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggacggtcactntctnttgtcnggancatcgtacanagtacggagtagatatgtatacgtcgtacagctacgtaccaagacggcccgaccccagtcctcctactactactaataaagtaaattagtacggaaccccggttccgtacggtaccggggtccctacggaccgttacttccgtcgtacggtaccgttaccgtaacggtttcggaccctacccgtccgtaccgtcccctcccgtacggaccctacgtacgtacgggtccggggtcccgtacccgggtaccggacgggtagtacgggacggtacgttagttaacgtttacgttacgtggttaggttagggaggtacgggacgtagtacgtacggtccgtaggtacgttcgtacgtttacgtcgttaccgttacgggtaaccggtcgggtaacccgtacggtacccgtaccggtaccggtacggtacccgaccg

SEQ ID NO: 335873 - DNA, 667 bp, Homo sapiens
  misc_feature: GZ8MTXP02I6O03.2.49.E05.1.454.CMB.2.raw
  modified_base (219)..(219): a, c, t, g, unknown or other
  misc_feature (219)..(219): n is a, c, g, or t
  modified_base (423)..(423): a, c, t, g, unknown or other
  misc_feature (423)..(423): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagtcaccctcagcgtctcggtacccccgggnaggagggtcaccatctcttgttctggaagcatgtccaacatcggaagtgataatgtatactggtaccagcagttcccaagacgccggcccccaagcctcctacatctataagaaattatagacccgtcctcgacggggtccctaggacccgtattcctcgtcggcttaccaagtctgggacctacctcgaccgtccctacccgnggacccagtcgtaaggtcgggacctccgggtccgagggtacgtaggacggtctaggtattttaacgttaccgttaggttcggtttagggacggttacgggaacctaagggcccgtaaggcccgtttaagggtaccgttcggttaccttttaagttcggtttaccgggttaccgggtaaaccggtcgggggtaaccccgtaaccggggtaccttaaccccgggttaccgttacggggtaaacccg

SEQ ID NO: 335874 - DNA, 649 bp, Homo sapiens
  misc_feature: GZ8MTXP02JV7XK.2.49.E05.1.454.CMB.2.raw
  modified_base (220)..(220): a, c, t, g, unknown or other
  misc_feature (220)..(220): n is a, c, g, or t
  modified_base (425)..(425): a, c, t, g, unknown or other
  misc_feature (425)..(425): n is a, c, g, or t
  modified_base (453)..(453): a, c, t, g, unknown or other
  misc_feature (453)..(453): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccgggnaggagggtcaccatctcttgttctggaagcatcgtccaacatcggaagtgaataatgtatacgtggtaccagcacgttccccaagacgcccggacccccaaagcctccctacacttctaataagtaaattagtacgtaaaccccggtcctcgacggggttccccctaggacccgtattccgtcgtcgggtcctaccgaagttccngggccctaccctcgaccgccccttccgnggcccatccgaggtcggggcctccggggtccgaaggactaggacggctagtacgttattacgtggttggttaggagtacggggactaggcgtaacgtccgtggaaggttgtaccgtttagtcggttacgttaccgggaaacgttcgggggtaaacccgtacggggtaccctacccgggttaccgtacggtacccgg

SEQ ID NO: 335875 - DNA, 579 bp, Homo sapiens
  misc_feature: GZ8MTXP02JMULP.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctcggtacccccgggnagagggtcaccatctcttgttctggaagcatgtccaacatcggaagtgataatgtatacgtggtaccagcagttcccaaagacgccggcccccaagcctcctcattctaatagaaattagtgaacccggtcctcgacggggtcccctgaccgtattcctctggcctacccgaagttctggcctaccctcgacgtccctcccgtcggccctatccgaggtcgggccgtcccgggtccgaggtcgtggacggtctaggtatttattacgtgtgttggagtgggacagcgacgtccgtgacgtgtcttagtcgtcgttacggaacgtcgggaccctacggtccacccgttcgtacggtaccg

SEQ ID NO: 335876 - DNA, 795 bp, Homo sapiens
  misc_feature: GZ8MTXP02HWZ2N.2.49.E05.1.454.CMB.2.raw
  modified_base (246)..(246): a, c, t, g, unknown or other
  misc_feature (246)..(246): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcggtacccccgggaggaggtcaccatctcttgtctggaancatcgtccaaacagtacggaagtgaataatagtatacgtcggtaaccagactacgttaccccaaaggaccgcccggaccccccaaaggtccctccctacaacttacctaataaagtaaaattacgtacggaaaccccggtcctaccggtacggggtcccctaggacccgtatttccctacgtcggaccttacccgtaaaggttccgtacgggtacccaaaccccttccgaaccgtcccccgttccccgtacgggacccctaactccggtaacgggttccgggggtaaccccgttcccgggggttaacccggaagggtacgtacgggacccgggttacttacggggttaatttaaaccgtttacgttggttaacgggggttttcgggaaaaggttccgggggtaaacgtacggaccgttaaacgggtccccgtttagggaaaccgttggttaccgtttaacggtcggtttacccgttaacggggtaacccggtacgggtaacccggtaccggtacccgttaccccggtacccgtttaacggaacccccgg

SEQ ID NO: 335877 - DNA, 788 bp, Homo sapiens
  misc_feature: GZ8MTXP02F9B3K.2.49.E05.1.454.CMB.2.raw
  modified_base (217)..(217): a, c, t, g, unknown or other
  misc_feature (217)..(217): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagagggtcaccatctcttgttctggaagcatgtaccaacagtcggaagtgataatgtatactggtaccagctacgttacccaagacgcccggcccccgagcctcctcatacctaataaagtaaattagtacggtaaaccccggtcctaccggtacggggttcccctacggaacccgttatttccgtcgtacgggtcccttacccgtaaacgttccgtcgggaccctaacccgttcccaacccggtcccccttccccggtcgggtaccccctaacgtccggtaacggggtccgggggtcccgttacccccgggtacccgggtaaagggtacgttagggacggggttcctacggtttaaattttaacgtttaaccgtttgggtttcgggtttaggggtaacggttacgggggaaacctacgggtacccgaacggttcccggttaggtaacgggttacggttcgtttaacgttcggtttacccgtttaaccgggggaaaccggtttaccgggggaaccccgttacccggggttacccgtaacccggtttacccggtaacggggtttaacccccg

SEQ ID NO: 335878 - DNA, 779 bp, Homo sapiens
  misc_feature: GZ8MTXP02FPFVH.2.49.E05.1.454.CMB.2.raw
  modified_base (181)..(181): a, c, t, g, unknown or other
  misc_feature (181)..(181): n is a, c, g, or t
tcagacgctcgacacacgaccggtgctcgatttagagcgactagcaacacacaaagggggggtaagctcagcttcagctgtggtagagaagacaggattcaggacaatctccagcatggccggcttccctctcctcctcaccctcctcactcactgtgcagggtcctgggcccagtctgtnctgactcagccaccctcagcgtctcggtacccccgggcaggacggtccacctattcttcttgttcgtggaaagctagtcgtacccaacagtacggaagtagaactaatagtaactacgtacggtaccagactacgtacccaaaggtcgccccggacccccaagtccctaccctactatacgttaaataaagtaaaactttacgtacggtaaaccccggttcccgtacgggtaccgggggtccccctacggaacccgttacgtttcctcgtacggtccttacccgaagttcgtacgacctaaaccctcgacccgtcccctaccccggtggaccctagtccgtacggggttccggggtcccgttacccgggggtaccggagggtaacgtacgggtaaccggttcgttagttaaacttttaccgttaccgttaggggtttagggtttaaacggggacggttaccggggaaactaccgggtacgtaaaccggtccgttagggtacggttacggtttaaccctttagttaccggttaccgtttaacggggaaaccggttccggaacccgtaccgtacccgtacccggtaccgtacggaccccg

SEQ ID NO: 335879 - DNA, 672 bp, Homo sapiens
  misc_feature: GZ8MTXP02FLC8P.2.49.E05.1.454.CMB.2.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnaggacggtcaccatcttcttgttcngganctatcgtaccaanagtacggaagtanataatgtatacgtacgtacagcgacgtaccaagacggcccgacccccaagtcctcctactatactataaagtaaattagtacgtacccggtcctacgacggtcctacgaccgtattctcgtcgtcctaccgtagtcgtacgaccctaccctcgacccgtccctcccgtcggaccctacgtcgtacgggtcgggtcccggtacccgggtaccggtaagggacgtacgggacggtcgttagttaacgtttacgtttacgttggttaggttagggtacggtagggacgacgtacgtacggtcgtaggtacggttcgttacgtttacgttcggttacgttaaccgggtaaccggtaccggggtaaccgtaccggtaccgtacccggttacgtaccggtacg

SEQ ID NO: 335880 - DNA, 738 bp, Homo sapiens
  misc_feature: GZ8MTXP02F06EW.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcgggtacccccgggnaggagggtcaccatctcttgttctggaagcatgtaccaacagtcggaagtgataatgtatacgtggtaccagcgtacgttcccgaagacggccccggaccccccaaagtccctccctctaacgtacttaataaagtaaaatttagtacggtaaccccggttcctacggtacggggtccccctaggacccgttacgttcctccgtcgggtacctacccgtaaagttccgtacgggaccctaccctccgtacccgcccccttacccccggtcgggtcccctaaacggttccgtaacggggttccggggtcccgttaccccgggggtaccggacggggtaacgtcggggtaacgggtccttagggttaatttacgtttaacgtggtttgggttagggaacgggttggggaactacggcctaacggtccgtagggtacgtcgggttactttacgttcggttacgttaccgggaacggtcgggacccgtacggtacccgtaacccggttcgtacggtacccg

SEQ ID NO: 335881 - DNA, 598 bp, Homo sapiens
  misc_feature: GZ8MTXP02F1I3X.2.49.E05.1.454.CMB.2.raw
  modified_base (340)..(340): a, c, t, g, unknown or other
  misc_feature (340)..(340): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgttctggaagcatgtccaacatcggagtgataatgtatactggtaccagcacgttcccaaagacgccggacccccaagcctcctcactctaataagaaattanagaacccggtcctcgacggggtccctagacccgtattctctggccttccaagtctggccacctnacgccctcccgnggccctatcgagtcggggtacctcccgggtaccgaggtacgtaggacgggtcttaggtaatttaacgttacgttggttaggttggaagttggggacaggctaacgtccgtaggtagtgtacttagtcgttccgttaggaacgtcgggaaccacgggttaccaccggttaccgtacggtaccg

SEQ ID NO: 335882 - DNA, 648 bp, Homo sapiens
  misc_feature: GZ8MTXP02GJL2C.2.49.E05.1.454.CMB.2.raw
  modified_base (543)..(543): a, c, t, g, unknown or other
  misc_feature (543)..(543): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcggtacccccgggagagggtccaccatctcttgttctggaagcatcgtaccaacagtcggaagtgataatgtatacgtggtaccagcacgtccaagacgccggacccccaagcctcctcactcttaataagtaaattagtacgaacccggtcctacggtacggggtcctacgaccgtattcctcgtcggtacctaccgaagttcgcggccaccctcgacgtccctcccgtggaccctagtccgtagggtcggggtccgttacccggtaccggaggtaacgttcggaacgggttcctagtaacttttagtacgttggttaggttggagtggggaacgngtacgacgtcgtaggtacgtcgttacgttacgtacggttacggttaaccgggtaacggtaccgggaacccgtacggtacccgtaccggttaccgtacggtacccg

SEQ ID NO: 335883 - DNA, 669 bp, Homo sapiens
  misc_feature: GZ8MTXP02I02T4.2.49.E05.1.454.CMB.2.raw
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttcctgttgctatttaaaggtgtcagtgcgaggtgctgctgggtggaggtccgggggagcttagttcaggcccgggggtcctgacgactctcctgtgcagcctctggattcaccttcagtcgctactggatgcactggtccgaccaagttccgaggggtaagggctgggagtgggtctcgacgtctattgaatccagttcgtaggggaaattagggaatttaaccgtacggcccggtcccttccggggtggacgggggtccctatttcccgaacctatccctacgaagacgaacgaaccgaccaaagggaaccaccttgtacgtaatccgtaaggaaaagtggaaacgctaggttacccacggaaggacgggaccggaggaacccggtaacgggtttcgtttacgtttaacttacgacgtacgtaaacggtaacggtacggtaccggtacggggttaacggggacttacggtaacggtacggtacggggtacggggaccgtacggggtactacggtttcgg

SEQ ID NO: 335884 - DNA, 716 bp, Homo sapiens
  misc_feature: GZ8MTXP02GKZOL.2.49.E05.1.454.CMB.2.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggnagaggtcacatctcttgtcnggancatcgacanancgatnatatntactatgacagctacgtaccaagacgccgaccccagcctccacatactaataaagtaaattagtacggaaccccgtcctacggtacggggtcccctaggacccgttattccgtcgtcggacctaccgtaacgtcgtacggaccctacctaccgaccgtccctcccgtacggaccctacgtccgtacgggtccggggtcccgttacccggggtaccggaagggtacgtacgggaacggtacgttagttaacgttttaacgttacgttggttacgggttaggggtaacggtacggggtaacgacggtaccgtacggtacccgttaggtaacggttcggttaacgtttacggttccggtttaacccggttaaaccggggtaaaccggttacccggggtaaacccggttacccgggttacccgtaacccggtttacccggttaaccgggtaacccg

SEQ ID NO: 335885 - DNA, 695 bp, Homo sapiens
  misc_feature: GZ8MTXP02IPQ0G.2.49.E05.1.454.CMB.2.raw
tcagacgctcgacacacgaccggtgctcgatttagagcgactagcaaacacacaaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggcagagggtcaccatctcttgttctggaagcatgtccaacatcggaagtgataatgtatactggtaccagcacgttccaaagacgccggcccccaaagcctcctcattctataagtaaattatggaacccggtcctcgacggggtcccctagacccgtattccgtctcggcctcccgaagtctggccaccctcacgccctcccgtggccctatccgtaaggttcggggaccgttcccggggtaccggaagggtagttacggaacggggtcttagggtactttaaactttacgttggtttgggtttagggaagttgggggaaacctaaggtcccgaaaagggtccccgttagggtaacgggtttcgtaccgtttaaagtttccggttccggtttttaacggggaaaacccggttcgggggaaccccgttaccgggggttacctaacccccgggtttaccgtttaaacggggtacccg

SEQ ID NO: 335886 - DNA, 817 bp, Homo sapiens
  misc_feature: GZ8MTXP02IXUZ1.2.49.E05.1.454.CMB.2.raw
  modified_base (224)..(224): a, c, t, g, unknown or other
  misc_feature (224)..(224): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcgagggtcctgggcccagtctgtgctgactcacgcccaccctcagcgtcgtccggtacccccgggnaggacggtcaccattcttcgttgttctaggaagcatcgtaccaacagtacggaagtagaataagtagtatacgtacggtaaccaggacctacgttaccccgaaaggacggaccccggacccccaagtcctcctactatactaataaagtaaattagtacggaaaccccggttcccgtacgtaccgggggttaccccctaggaacccgttactttcccgtccgttacgggtcccttaaccgtaaacgggtttcccgaccgggtacccctaaccccgttcccgaacccggtccccccttccccggttacggaccctaacgttaccggaacggggttcggggtccccgttaccccgggggtaccggtaagggtaaccgtaggggaacggttacgttacggtttaattttaacgtttacggttgggtttagggtttacggggtagttaacgggggaacctacgggaccgtaaccggtaccgttaggggtacgttcgttacgtttacggttacgtttaccgttaaccggggtaaccggtacccggggtaacccgtacccggttcccgtaaccccggttaccggttaaccggtaacccg

SEQ ID NO: 335887 - DNA, 692 bp, Homo sapiens
  misc_feature: GZ8MTXP02INPMO.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgacctcagccaccctcagcgtctcggtaccccccgggnagagggtcaccatctcttgttctggaagcatgtccaacatcggaagtgataatgtaatacgtggtaccagcacgttcccaaagacgccggcccccaagcctcctcatctataagtaaattagtcgaacccggtcctcgacggggtccctaggtacccgtattcctcgtcggccctaccgaacgttctcgggaccctaccctcgcccgtccccgtacccgtcggtaccctacgttccggtacggttcggggacccgtttccccggggacggtaacgggtagttcgggaacggttccgtagggtttaatttaaccgtttacggttggtttcggggtttaggaaggttagggaccgacgtcgacggtccgtaggtacggttacgttacgtttacgttcggtttacggtttaaccgggaacggtccggggaaccgttaccggttaccgtacccggttttaccggaacgggtacccg

SEQ ID NO: 335888 - DNA, 655 bp, Homo sapiens
  misc_feature: GZ8MTXP02G6UPP.2.49.E05.1.454.CMB.2.raw
  modified_base (222)..(222): a, c, t, g, unknown or other
  misc_feature (222)..(222): n is a, c, g, or t
  modified_base (555)..(555): a, c, t, g, unknown or other
  misc_feature (555)..(555): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtcgtcgggtacccccggnaggaggtccacatctcttgttctggaagctatcgtaccaactagtacggaagtgaataagtgtaatacgtggtaccagctacgtacccgaaagcgcccgacccccaagcctccactacttactaataaacgtaaattagtacggtaaaccccggttccctacggtacggggttcccctaggtacccgttactttccgtacgtcggtacctaccgaacgttcgtcgggacctaccctcaccgtcccctccgtcgccacgtcgaggtccgggaccgttccggacggagtatacgggagtctagtatttacgtacgttggtaggtggagtccgganacgcgtacgtcgtaaggcgttcgtacttaggtccgtttacgtaccgggaacggttccgggaacccgtacgggtcccaacccggtttccggtacgtacccg

SEQ ID NO: 335889 - DNA, 794 bp, Homo sapiens
  misc_feature: GZ8MTXP02I16D1.2.49.E05.1.454.CMB.2.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccacctcagcgtcgtcggtaccccggnaggacggtcaccatctcttgttctggaagcatcgaccaanagtcggaatgataatgtatacgtggtaaccagcgtaacgttaccgaaaggaccggccccggaaccccccaagtcccttcccgtactaacttaccttaagtaaacgtaaaattagtacggtaaccccggttacccgtaccggtacggggttcccctacggaaccgttacttttccgtaccgttcgggtaccttaccgtaaacgttccgtacgggccctaacccgtcctaaccgtcccccttaccccggtcggtaccctaaacgttccgtaacggggtcccgggttacccggttccccgggggtaccggtaacgggtaaacgttacggggaacggttcgttaacgttaacgtttaaacgtttccggttaggggtttgggtttacggggtaaggttacgggggaaacctacgggactaacgggtccgttagggtaacgttcggtacgttttagttccggttacggttaaccggggtaaccggtaccggggtaacccgtaccggggttccctaaacccggttccggtaacggtaaccccg

SEQ ID NO: 335890 - DNA, 740 bp, Homo sapiens
  misc_feature: GZ8MTXP02IO05U.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggagggtcaccatctcttgtctggaagctatcgtccaacagtcggaagtgaataatgtaatacgtggtaccagctacgttcccaagacgcccggaccccccagcctccgtcatactaataagtaaattagtcgaacccgtcctcgtacggggtccctagtaccgtattcctcgtcggacctacccgtaagttcgtcggacccacccttcaccgtccctcccgtcggtaccctacgtcccgtagggtccggggtccgtcccgggtacccggaggtcgttacgggacgggtcttacgggttaactttaacgtttaacggttcgggtttagggtttacgggtaacggttacgggggaaccaacgggtaccgtaaacgggtccccggtttagggtacggtttacggttaccgttttaacgtttcgggtttaacccggtttaccggggtaaaacccgggttcgggggaacccccgttaccggggttaccccgtaaaccccgggtttcccggtaacggggtaccccg

SEQ ID NO: 335891 - DNA, 510 bp, Homo sapiens
  misc_feature: GZ8MTXP02GMPOP.2.49.E05.1.454.CMB.2.raw
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccggcagagggtcaccatctcttgttctggaagcatgtccaacatcggaagtgataatgtatactggtaccagcagtccaagagcgcccccaagctcctcatctatagaaattatgaaccgtcctcaggggtccctgaccgattctctggctccagtctggcacctcagcctccctggcccatcagtcgggctccggtccgaggatgaggctgattattactgtgttggatgggacagcagctgagtgcttagtcgtcttacggaacgtcgggacctacggtccaccgtcctaggtccg

SEQ ID NO: 335892 - DNA, 744 bp, Homo sapiens
  misc_feature: GZ8MTXP02IN6DH.2.49.E05.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtctcgggtaccccccggaggnggtcacatctcttgtctggaancatgcaangtcggaagtgatangtatacgtggtaccagctaacgtcccaaagacgccccggaccccccaagtcccttccctacacttacctaaataaagtaaattaacgtacggtaaaccccgggttccctacggacccgggggttcccctaggtaaaccccggttactttcccgttcgtacgggtaccccttaacccgtaaacgggttccgttaccgggaccctaacccgttcgacccgttcccctaccccgttcgggcccctaaagtccgtaacggggttccggggtacccgttccccggggaaccgagggtacgttaccgggagggttacctggtttaaactttaacgttcgttggttaggttcggacggtaggggaccaaggaccgtacgtccgttaggacgtttggtaactttcgtacggttccgtttaaacggggaaacgttccgggaaccctaccgggttacctaccggtttacccgtagtaaccccgg

SEQ ID NO: 335893 - DNA, 833 bp, Homo sapiens
  misc_feature: GZ8MTXP02GUTQZ.2.49.E05.1.454.CMB.2.raw
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctcgggcccagtctgtgctgactcagccaccctcagcgtctcgggtaccccggnaggacgggtcaccatctcttgtcgtggaancatcgtaccaacatacggaagtgaataatgtatacgtggtaccagctacgtacccgaaggacgcccggacccccaagtcctccctacaacttactaaagtaaacgtaaaatttacgtacggtaaaccccggttccctacggtaaccgggggttcccctaggaaccccgttattttcccgtacgtcggggtacccttacccgtaaacgttccgttaccgggaccctaaccccgttcaacccggtccccttcccccggtacgggtacccctaacgtcccggtaacggggttcccgggggtacccgtttccccgggggtaacccggaaggggtaccgttaggggaacggggttcttaacgggttaactttttaacgtttaaccgggtttgggtttacggggtttagggggaaacggttgggggaaacctaagggccgtaaaccgggtccggttagggtaaccggtttacggttcttttaacggtaccggtttcccggttaaaccgggggtaaacggttcccgggggaaaaccccgttaaccgggttcccgtaaaaccccggtttccggtttaacggggtaaccccgg

SEQ ID NO: 335894 - DNA, 796 bp, Homo sapiens
  misc_feature: GZ8MTXP02F790T.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcggtaccccgggnagagggtcaccatctcttgttctggaagcatcgtccaacatcggaagtgaataatgtatactggtaccagcacgttcccaagacgccggacccccaagcctcctacactacttataaagtaaattatacggaaaccccggttcctacggaacggggttccccctaggtaacccgttactttccgtccgttcggggtaccttacccgaaaggtttccctacggggccctaaccccgttcgaacccggtccccttcccccggtggtaccccaagttccgtacggggttccgggggtacccgttacccccgggggttacccggaaaggggacgtttcggggaccggggttaccttagggttaaacctttttacgtttaaccgttggggtttcgggtttaacggggtagggtttcgggggaaaccttacgggacccggtaacggtcccgttaggggtaacggttaacggttcgtttttaacggttacggtttacccgggtttaaccggggaaaccggttcgggggtaaaccccgtacccggggttacccgtacccggttacccgtttacggggaacccccg

SEQ ID NO: 335895 - DNA, 599 bp, Homo sapiens
  misc_feature: GZ8MTXP02JEI5J.2.49.E05.1.454.CMB.2.raw
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcaggaggtcaccatctcttgttctggaagcatcgtccaaacagtcggaagtgataatgtatactggtaccagcacgttcccaagacgccggcccccaagcctcctcatctataagaaattntgaacccgtccncgacggggtccctgaccgattccncgtggtcctaccgaagtctcggcccacctcacgccctcggtacggccctagactcggtcggggtcctcccggggtacccggagggtacgtggacgggtcttaggtatttagttacgtggttggttgggattcggggacaggtcgacgtccgtaggcgtgtcttagtcgttaccgttacgggaacgtcggggaccgtaccggtactcccggtacgtaacggtccg

SEQ ID NO: 335896 - DNA, 593 bp, Homo sapiens
  misc_feature: GZ8MTXP02GJRWJ.2.49.E05.1.454.CMB.2.raw
  modified_base (219)..(219): a, c, t, g, unknown or other
  misc_feature (219)..(219): n is a, c, g, or t
  modified_base (514)..(514): a, c, t, g, unknown or other
  misc_feature (514)..(514): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcacccctcctcactcactgtgcagggtcctgggcccagtctgtgctgactcagccaccctcagcgtctcggtacccccggnagagggtcaccatctcttgttctggaagcatgtaccaacatcggaagtgataatgtatactggtaccagcacgttccaagacgccggaccccaagctcctcatctaatacgtaaattataggaaccccgtcctacgacggggtccctgacccgtattccgtctcggacttacccaagttctacgggcctaccctcacggtccctcccgtggccctatccgaggtcgggccgtcccggtccgaggtacgtggacggtctagtaatttagttaccgtgttggttaggagtcgggganacggacagtccgtagtacgtcggtacttagtcgtcgttacggaacgtggggaaccctcggtaccaccgtctacggtacc

SEQ ID NO: 335897 - DNA, 714 bp, Homo sapiens
  misc_feature: GZ8MTXP02GVPXK.2.49.E05.1.454.CMB.2.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggtacccccgggnaggacggtcactattcttcttgtcgtaggacncagtcgtaccaacagtacggaagtanaataatgtatactgtacagctacgtaccgaagcgacccggaccccagcctcctactacttactaagtaagtaaattacgtacgtaaccccggtccgtacggtaccgggtcctacgtaccgttacttccgtcgtcgtacctaccgtacgtcgtacgccctacctcgacccgtccctcccgtcgaccctacgtaccgtacgggtccggggtcccgttacccgggtacggtaacgggtacggtacgggtacggttcttaggttaagtttacgttacgttagggtttcggttacgggtaacggtagggaacgtacgtacgtacggtcgttaggtacgttacggttacgtttacgttaccggttaccggttaaccgggtaaccggttaccgggtaacccgtaccgggttacccgtaacccggttaccggtaacggtcccg

SEQ ID NO: 335898 - DNA, 658 bp, Homo sapiens
  misc_feature: GZ8MTXP02FQEJ9.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctggtacccccgggnagaggtcaccatctcttgtctggaagcatgtccaacatcggaagtgataatgtatactggtaccagctagttccccaagacgccggacccccaagcctccctacatctaataaagaaattagtagaaccccggttccctacgacgggggttcccctggacccgtattctcgtggcctaccgaagttctcgggccaccctcacgtccctacccgtggcccatcgaaggtcgggtcccgtcccgggtcccgaagggtcttagggacggtcgtagtattttacttaaccgttggttgggttcgggaagttgggggaacgacggcgaacggtcccgtaggtaggttcgtaccgtttagttacggttcgtttaccggggtaaacgtcgggggtaaacccctaccgggggttaccctaacccggttacccgtacgggttaacccgg

SEQ ID NO: 335899 - DNA, 703 bp, Homo sapiens
  misc_feature: GZ8MTXP02HFDRF.2.49.E05.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcacgcccaccctnagccgtctcgggtaccccccgggnaggacgggtccaccatcttcttgttctggaagcatgtacccaacagtacggaagtagaataaatggtaatacgtaggtaccagctacgttaccccaagcggacccggacccccaagtcctcctcactctaataaagtaaattatacgaacccggtcctacgtacggggtcccctaggaccctattccgtacgtcgggtacctacccgtaaagttccgcgggtaccctacccgtccaccggtcccctcccgtcggaccctagttccgacgggttccggggtccgttaccccggggaccggtaagggtacgttacgggaccgggttacgttacgtaagttttacgttacgttgggttagttgggtagtcgggactagccctaggccttaggagttacgtactttacggtcgttacccgtttacgggaaccgttcggggaacccgtccggttaacccgccgtttaacccggtacggtaacccg

SEQ ID NO: 335900 - DNA, 743 bp, Homo sapiens
  misc_feature: GZ8MTXP02HIV3C.2.49.E05.1.454.CMB.2.raw
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtccgggtacccccgggnaggagggtccacctattcctcttgttctaggaagcatgtaccaanagtacggaagtagtaataatgtatacgtaggtaccagtctacgttaccgaaggacgccccggaccccaagtccctacctacacttacttaaagtaaagtaaacttacgtacgaaccccggttccctacggtaccggggttaccctacggtaccgttacttccgtacgttcggacccttaccgtaacgttcgtacggaccctaccgttcccgtaacccggtcccctccccgggtacgacccgtacgtccggaggggttcccgggacccgttaccccggggacggtaaaggtgtacgggtacgggtacttaggttaacgtttacgtttacggtggtttagggtacggtagggtacgggaactacggtacgaacgttcgtggtaacggttccttagttacgtaccggttacgtaccgggtaacgtccggggtacccgtaccggtacccgtaccgttaacggtaccggtaaacccgg

SEQ ID NO: 335901 - DNA, 510 bp, Homo sapiens
  misc_feature: GZ8MTXP02FONB5.2.49.E05.1.454.CMB.2.raw
  modified_base (427)..(427): a, c, t, g, unknown or other
  misc_feature (427)..(427): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttccccaagagcggccccccaagcctcctcatctatagaaattatgaaccggtcctcgaggggtccctgaccgattctctggctccaagtctggcacctcacgccctccctggcccatcagtcggctccggtcgaggntgagctgattatactgtgtggatgggacagcagcctgagtgcttatgtcttcggaactgggacacggtcaccgtcctaggtcc

SEQ ID NO: 335902 - DNA, 652 bp, Homo sapiens
  misc_feature: GZ8MTXP02G3KEH.2.49.E05.1.454.CMB.2.raw
  modified_base (224)..(224): a, c, t, g, unknown or other
  misc_feature (224)..(224): n is a, c, g, or t
  modified_base (565)..(565): a, c, t, g, unknown or other
  misc_feature (565)..(565): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtccgggtacccccggnaggacgggtccaccatcttcgttgttcgtggaagctagtcgtaccaaacagtcggaagtgaataatgtattacgtggtaccagcgacgttacccaagacggccccggtacccccaagtcctcctactactacttaataaagtaaattacgtacggaaaccccgttccgtacggtacggggtcccctaggacccgttattcctcgtcggccctaccagtcctgggacctaccctcgaccgtcccctcccgtcggcccagtccgagggttccgggcccgtcccgggtaccggaaggtgtggacggtcttagtagttatacgtggttaggtaggagtcggaacngtcacggtcgagtgtagtctttagtcgttccggtacggtaaccgtacggtacctccggggttacccaccggttccgtacggtacccg

SEQ ID NO: 335903 - DNA, 720 bp, Homo sapiens
  misc_feature: GZ8MTXP02J159P.2.49.E05.1.454.CMB.2.raw
  modified_base (220)..(220): a, c, t, g, unknown or other
  misc_feature (220)..(220): n is a, c, g, or t
  modified_base (322)..(322): a, c, t, g, unknown or other
  misc_feature (322)..(322): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnagagggtcaccatctcttgtctggaagcatgtaccaacagtcggaagtgataatgtatacgtggtaccagctacgttccaagacgccgcccccaagcctccncatctaataagaaattgacgtaacccgtcctacgacggggtccctgacccgttattccgtcgtgggtccctaccgtaagtccgttacgggccctaacccgttcgaccgtccccctccccgttacggacccctagtaccgtacgggtccggggtaccccgttccccggggttaccggaaagggtacgttacggggacggtaccgttagggtaacttttaagttaccgttgggtttacgggttagggtaaggttacgggggtaactacggacgtaaccggtcccgttagggaacggtttcgtaccgtttaaggtcggtttaccggtttaaccgggaaccggtttaccggggaacccgtaccgggtaccgtaccccggttaccggttaccggtaaccccgg

SEQ ID NO: 335904 - DNA, 667 bp, Homo sapiens
  misc_feature: GZ8MTXP02F45VH.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnagagggtcaccatctcttgttctggaagcatcgtaccaacatcggaagtgataatgtatactggtaccagctacgtcccaagacgccgacccccaagcctcctcatctaataagaaattagtagaacccgtcctacgacggggtccctgaccgtattcgtctcggcctaccaagttcgtcggccctaccctcgacccgtccccttccccgtgggacccctagtcccggtaagggtccggggtcccgttaccccggggtaccggaagggtacgttagggaacgggtccttagttaaacgttttaacgttacgtttggttggtttagggtacggttaggggaacccaggtccgaacggtccgtaggtacggttcgtacgtttagtcggttccgttaacggtaacgtcgggacccgtaccgggtcctacccggttaccgtacggtaacccg

SEQ ID NO: 335905 - DNA, 616 bp, Homo sapiens
  misc_feature: GZ8MTXP02IGU0H.2.49.E05.1.454.CMB.2.raw
tcagacgctcgacacacgaccggtgctcgatttagagcgactagcaacacaccaaaggggggggaagctcagcttcagctgtgggtagagaagacaggattcaggacaatctccagcatggccggcttccctctcctcctcaccctcctcactcactgtgcagggtcctgggcccagtctgtgctgactcagcccaccctcagccgtctcggtaccccccgggcagagggtcaccatctcttgtctggaagcatgtccaacatcggaagtgataatgtatactggtaccagtcagttccccaagacgccggtacccccaagtcctcctcatctaataacgaaatttatacggaacccggttcctacggacgggggtcccctaggacccgtatttcctcgttggacctaccgtaagttcctggccacctcacgtccctccctgggacccagtccgaggttcgggccttccgggaccgaggagtgaggtcttagtactttattacgtgtgttaggagttggggaccagcgacgtccgtagacggttgacgtttagtcgtttctaccggaacgttcggggaaccctacggggtactaccccggtactaacggggtcccg

SEQ ID NO: 335906 - DNA, 664 bp, Homo sapiens
  misc_feature: GZ8MTXP02JLOO4.2.49.E05.1.454.CMB.2.raw
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactaactgtgcagggtcctgggcccagtctgtgctgactcagcccaccctnagcgtctcgggtacccccggnaggagggtcacatctcttgtctggancatcgtccaacatcggaagtgataatgtatacgtggtaccagcacgttacccaagacgcccggaccccaagcctcctcaattctaataagtaaattacgtacggtaaccggtccccgtacgtaccggggtccctacgtaccgtattcctcgtcggtactaccgtaagtcgtcggaccctacccgtccacgtcccccgttcccgtcggaccctacgtacgtacgggtcgggtcccgtccgggtaccgtaggtacgtcggaggtcgttagtatttagttacgttggttggttaggtagtacgggactacggacgacgtacgtggtagttcgtacgtttacgttcgggttaccggttaaccggtacggtaacggtacccgtaccggtaccgtacccggttacgtaccggtaccgaacccgg

SEQ ID NO: 335907 - DNA, 539 bp, Homo sapiens
  misc_feature: GZ8MTXP02HWJX7.2.49.E05.1.454.CMB.2.raw
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaggtgtccagtgcgaggtgctgctggtggagtccgggggagcttagttcagccgtggggggtccctgagactctcctgtgcagcctctggattcacccttcagtcgctactggatgcactggttccgccaagttccgaggggaggggctggagtgggtctcacgcattgatccatccgtagggaataggattaacgacgcgcctcgngacgggccatcacatcncagacgacacgcagaacactctgtatctaggaaatgagcagtctacgaggaggcgaacggacgacggtcttagtttatacgtgacacaaaggtcgacgtcggttacgggggataacgtggacgtacggtcggggacccaggggctagg

SEQ ID NO: 335908 - DNA, 705 bp, Homo sapiens
  misc_feature: GZ8MTXP02JJ1RC.2.49.E05.1.454.CMB.2.raw
  modified_base (225)..(225): a, c, t, g, unknown or other
  misc_feature (225)..(225): n is a, c, g, or t
  modified_base (683)..(683): a, c, t, g, unknown or other
  misc_feature (683)..(683): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagccgtcgtccgggtaccccccgggnaggacgggtccaccattccttcgttgttcgtaggaacgctattcggtacccaaacgtacgtacggaagtagtaataagtagtaactacgtacgggtaccagtacctaacgttcccgaaagcggccccggtacccccaagtcctcctacacttactaataagtaaaattcgtacggaaccccggttcctaccggtacggggttcccctaggacccgttattccgtcgtcggtacctaccgtagtcgtcgacccacccgtcacccgtccctcccgtaggtaccctagtccgtagggtcgggtccgtcccggggttacgagggtactcgggacgttcgtagtaactttacgtacgtggttaggttaggcgtacgggacacgtcgtacggtccgttaggtcgttacgtactttagaccggtttcgtacgggtaaacgttccgggaaacccgttcgggtaccncccggtttacgacggtaccccg

SEQ ID NO: 335909 - DNA, 599 bp, Homo sapiens
  misc_feature: GZ8MTXP02F3UPV.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggcagagggtcaccatctcttgtctggaagcatgtccaacatcggaagtgataatgtatactggtaccagcacgtacccaagacgccggcccccaagctcctcatctaataagaaattatagaacccgtcctcgacggggtccctgaccgtattcctcgtcggcctacccaagtcgtcggcctaccctcacgtccctcccgtggccctatccgaggtcgggcctaccgggtccgagggtatggacggtcttaggtaatttactacgtggttggttagggagtacggggactaaggctaacggccttagggagttcggtactttagtcgttcgttacggaaacgtcgggaacctacggtactacccggtccgtacggtaacccg

SEQ ID NO: 335910 - DNA, 672 bp, Homo sapiens
  misc_feature: GZ8MTXP02I60B8.2.49.E05.1.454.CMB.2.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (401)..(401): a, c, t, g, unknown or other
  misc_feature (401)..(401): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccacctcagcgtctcggtaccccgggnagaggtcaccatctcttgttctggaagcatgtccaanagtcggaagtgataatgtatacgtggtaccagcagttacccaagacgccgaccccaagctcctcatctataagtaaattatacggtaaccgtcctacgacggggttccctagaccgtattccgtactgggccttaccgaaagtttcngggaccctaaacccgtcgtacccggcccttccccgttaggaccctaacgtaccgtaacgggttcgggacccgttacccggggttacccggaagggaaagttcgggaaacgggtccttaggtaaattttaccgttaaacgttgggtttagtttaggggaacgttagggggaaacctaggcaacggtccgtagacgttcgtactttagtacgttccgttacggtaacgttaccgggaccgtacggtaccgtaccggtttccgaaggtaccccg

SEQ ID NO: 335911 - DNA, 749 bp, Homo sapiens
  misc_feature: GZ8MTXP02G34PL.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccggnaggagggtcaccatctcttgttctggaagcatcgtaccaacatcggaagtgataatgtatacgtggtaccagcagttccaagacgcccggaccccaagcctccctcaatcctaataaagtaaatttagtcgaaacccggttccctcggtaacggggtccccctaggacccgtatttccgtcgtcgggtacccttacccgaaaggttcctacgggacccctaaccccgttccaaccggttccccctccccgttacgggacccctaagtcccgaagggttcccgggggcccttccccgggggtacggaaacgggtgttacgggacgggtcgttaggttaaattttaacgtttaaccggttgggtttacgggtttagggaaggtttacgggggaaccgtacggaccgtaaacggtcccgttaggtaaccggttggttactttacggtccgtttcggtttaaccgggggaaacgtttccgggggaaaccccttaccggggtaccctacccggttacccggttaaggtacccccgg

SEQ ID NO: 335912 - DNA, 659 bp, Homo sapiens
  misc_feature: GZ8MTXP02IVYPL.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccgggnaggaggtcaccatctcttgttctaggagcatgtccaacatcggaagtgataatgtatacgtaggtaccagcacgtccgaagacgccggaccccccaagtcctccctacattcctataagtaaattagtacggtaacccggttccctcgtaacggggtcccctaggacccgttattccgttccgtgggccctacccgtaagttccgtagggcccacccttcaccgtcccctccccgtggcccaagttccgaggtcgggcccgttcccgggtacgagggtagtcggacggtccgtagtacgtttacttacgttgttaggttggaagttgggacgagccgtaggtcccttagggtacgttcggtactttacgtacgtttccgttaacggggtaacctcgggggaacccgtaccggtccgtaacccgtccgtaggtaaccccg

SEQ ID NO: 335913 - DNA, 722 bp, Homo sapiens
  misc_feature: GZ8MTXP02HD0NZ.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtaccccccgggnaggaggtcaccattctcttgtctggaagcatgtaccaacagtacggaagtgaataagtgtatactaggtaccagctacgttaccgaacgacggcccggaccccccgaaagtccctccctacctaataccttaaataaagtaaaattagtacggaaccccggttcccgttacgacggggttcccctaggtacccgtattcctccgtggcccttaccgaagttccgtcgggaccctaccctcgaccggtccctcccgtggccctacgtcgtacgggtcggggtcccgtacccgggtcccggtaaggacgtacggtacggtccgttagttaacgtttacgttaaccggttggtttaggggtttcgaaagggttcgggaaccgtaggacccggtaacgtcccgtaggtaacgtccgggttatttacgtcggttaccgttaaccggggtaaccggttccgggaacccgttacggtcccgtaacccggttcgtaacgggtaccccgg

SEQ ID NO: 335914 - DNA, 680 bp, Homo sapiens
  misc_feature: GZ8MTXP02GQILR.2.49.E05.1.454.CMB.2.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
tcagacgctcgacacacgaccggtgctcgatttagagcgactagcaacacacaaagggggggaagctcagcttcagctgtggtagagaagacaggattcaggacaatctccagcatggccgcttccctctcctcctcaccctcctcactcactgtgcagggtcctgggcccagtctgtgctgactcacgcccaccccagcgtcgtcgggtacccccggaggacgggtccaccatccttcttgttctaggaancatcgtaccaacngtcggaagtgaataatgtatactggtaccagcagtcccaagacgccgacccagctcncatctaatagaaattanacgtaacgtccctcgacgggtcctagaccgtattctcgtcggcctaccgaagttccgacggaccctaaccctcgaccgtcccccgttacccgtcgggacccaagtttcccgagggttccggggacccgttccccggggtaccgaagggtagttacgggacggtccttagtactttagtttaaccgtggttaggttcggaagttacgggggaacctaaggcccgtaaggtccgttagggtaaccgttgtaccgtttaagtcggttacccgttacgggtaaaccgtcggggtaaccctacgggttacccgacccggtttaccggtaacgggtaccaaccccgg

SEQ ID NO: 335915 - DNA, 805 bp, Homo sapiens
  misc_feature: GZ8MTXP02GAZKD.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagcgtctcgggtacccccgggnaggagggtcaccatcttcttgttctggaagcatcgtaccaacagtacggaagtagataatgtatacgtggtaccagctacgttccaagacgccgacccccaagcctcctctatcttaataaagtaaattacgtacggtaaaccccggtcctacggacggggtacccctcggaccgtacttccgtcgtcggtacctaccgaagttccgtacggacctaaccctcgaccgtccccgtccccgtacgggccctaacgtcccgtaacggggttccgggggtccccgttaccccgggggtacccggtaaacggggtaacggtaccggggtaacgggggttacccgtttaagggttaaacgtttttaaacgtttaaacccggtttaggggtttcgggggtttaacgggggtaaacggtttcgggggaaacctaacggggtcccgtaaacgggtccccggttagggttaccggttaggttacgttttaaacggttcggtttaccggtttaaaccggggtaaccggtaccggggttaacccggttaaccgggttacccgtaaaccccggttaccggttaccgggtaacccgg

SEQ ID NO: 335916 - DNA, 715 bp, Homo sapiens
  misc_feature: GZ8MTXP02HYUAR.2.49.E05.1.454.CMB.2.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (399)..(399): a, c, t, g, unknown or other
  misc_feature (399)..(399): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcacccctcctcactcactgtgcagggtcctgggcccagtctgtgctgactcagcccaccctcagcgtcgtcggtacccccggnaggaggtcacntctcttgtctggancatcgaccaactgtcggaagtgaataagtgtatacgtcggtacagctacgttcccaagacgccccggacccccaagtcctaccctacattactaagtaaagtaaattagacggtaaccccggtcctacggaccggggtccctagaacccgttnttcctacgtcggtccttaccgaagttccggtacgccctaaccctcgaccgtccccctcccgtacggaccctagtccgtaggggtccgggtacccgttcccggggaccggaggtacgtcgggtacgggtcttaaggttaatttacgtttagttgggttaggttaggggtaacgtacgggggacctaggaccgtacggtccgttagggtaacgttcgttacgtttaacgttccggtttacccggttaacgggtaaccggttaaccggggaacccgttaaccgggttaccctaacccggttaccggttaacgaccccgg

SEQ ID NO: 335917 - DNA, 720 bp, Homo sapiens
  misc_feature: GZ8MTXP02G1G9Z.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtcggtacccccgggaggacggtcaccatctcttgttctggaagcatgtaccaaacagtcggaagtgaataatagtatacgtggtaccagctacgtacccaaggacgcccggacccccaagccctccctactaacttactaaataaacgtaaatttacgtacggaaaccccggtcctacggacggggttcccctaggacccgtattcctcgtcggcctaccaagtctcgcctacctcacgtccctcccgtcggccctagtccgacgggtcgggtcccgtacccggggtccggaaagggtgttacgggaacggtcgttaaggttaattttaaacgttccgttagggttacgggtttagggaggttacgggggaaacctcggaccgtaacggttccggtaggtaacggtttggtacccgttttaagtccggtttaccggttaaccgggaaaaccggttccggggaaacccgtaaccgggttcccgtaaccccgtttaccggtacggtaaccccgg

SEQ ID NO: 335918 - DNA, 770 bp, Homo sapiens
  misc_feature: GZ8MTXP02HZNEW.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtctcggtacccccgggnaggacggtcacctatcttcttgttctaggaacgcatcgtaccaaacagtacggaagtgaataagtagtaatacgtacggtaaccagtactacgttacccgaaaggaccggccccggacccccaagtccctaccctactacttacctaataaacgtaaattacgtacggtaacccgtccgtacggtaccggggtcccctagtacccgttacttccgtcgttacggtaccctaccgtaacggttccgtacggtaccctaccctcgacccgtaccccgtcccgtcggaccctacgtaccgtacgggtccggggtccgttacccggggtacgaagggtacgtacgggtacggttaccgttaggttaacctttaacgttaacggttcggtttagggttacgggaacgggttacggggacgacggtaccggtacggtaccgttagggtacgtttacggttaccttttacgttcggtttaccggttaaccgggtaaccggttaccggggtaaccgtacccgggttacccgtacccggtttaccgttacgggtacccg

SEQ ID NO: 335919 - DNA, 778 bp, Homo sapiens
  misc_feature: GZ8MTXP02GQGUI.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnaggagggtcacatctcttgtctggaagcatgtccaacatcggaagtgataatgtatacgtggtaccagctacgttaccaagacgccggacccccaagcctcctcactactaataagtaaaattatacggtaacccgtcctcgacggggttccctaggtaacccgttattccgtcgtcggtacccttaccgtaaacgtcttacggaccctaacccgttcctaacccgtcccccgttccccgtcgggtacccctacgttacccgaacgggttaccgggggtccccgttccccggggtacccggtaaagggggtacgtttacggggaacggggttccgttaggttaaacggttttaacctttaaccgtttcggggttagggttttaggggtacgttaagggggtaaccgtacggaccgtaacggtcccggtagggttaaaccggttggttaacgtttacgttcggtttacccggttttaaccggggaaacggtttccgggggaaaccccggtacccggggttacccgtaaccccgggttaccggttaaccgggtaaaccccgg

SEQ ID NO: 335920 - DNA, 779 bp, Homo sapiens
  misc_feature: GZ8MTXP02HOE8Q.2.49.E05.1.454.CMB.2.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtaccccccgggnaggacgggtcaccatctcttgttctaggaanctatcgtaccaacagtacggaaagtgaataatgtaacttacgtacggtaaccagactacgttacccgaaggaccggccccggaccccccaagtccctccctacacttctaaataaagtaaattacgtacggtaaaccccggtccctacggtaacggggtcccctaggtacccgtatttccgtacgtcggtaccttacccgtaagtccgtcgggaccctaacccgttccgaccgttccccctccccgtagggaccctacgtccggtacgggttccgggcccgttaccccggggtaccggtaagggtccgtttaaggggacgggttacttacgggttaattttaaaccgttaccggtttgggttcgggtttaaagggaggttacgggggtaaacccgtacggtaccggtaccgggttaccgttaggggtacgtttacggttacgttttacggtccggtttaaccggttaaccggggtaaccggtccgggtaacccgtaccggtaccctacccggttcgtaacggtacccg

SEQ ID NO: 335921 - DNA, 730 bp, Homo sapiens
  misc_feature: GZ8MTXP02F9U6W.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccggnagagggtcaccatctcttgttctggaagcatcgtaccaacatcggaagtgataatgtatactggtaccagcacgttacccaagacgcccggacccccaagcctccctcactactaataagtaaattagtacgtaacccggtccctacgtacggggtccctacggaccgtatttccgtctcgggtcctaccgaagtcgtcggccctaccctcaccgtcccctcccgtcggaccctatccgacgggttcggggtcccgttcccggggtacggaggtacgttacgggacggtaccgttaggttacttttaacgtttaacgttgggtttagggtttacgggtaaggttacgggggaactacgggacgtaaccgggccgtttagggacgtttacggttacgtttacgtttacgggttacccgttttaaccgggggaaccggtttaccgggggtaacccccttaaccgggggttacccttaaccccggggtttaccgttaaccggggttaacccccgg

SEQ ID NO: 335922 - DNA, 819 bp, Homo sapiens
  misc_feature: GZ8MTXP02GABPV.2.49.E05.1.454.CMB.2.raw
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagccgtctcgggtacccccggnaggaggtccaccatctcttgttctggaanctatcgtaccaanagtacggaagtgataatgtactacgtcggtaccagctacgtacccaaggacgccggacccccaagccctcctacatacttaaagtaaagtaaaatttacgtacggtaaccccggttcctacggtaacgggggtccccctaggtaacccgttatttccgtcgtcgggtacccttacccgtaacgttccgtacgggaccctacccgttccgacccggtccccttccccgtacggaccctacgtccgtaacgggttcggggtcccgttaccccggggttaccggaaggggtacgttagggtacgggtaccgtttaaggttaaacgttttaacgtttaaccggttgggtttcgggtttacgggggttaacgggttacgggggtaaacgtcggggtaaccctaacggggtcccggttaaggggtacgggtttaccggttacttttaacggtttccgggttaccggtttttaaccggggaaaccgggtttaccgggggaaacccgtttaccccgggggttacccgttaaaccccggttcccggtttaaccgggtaacccccgg

SEQ ID NO: 335923 - DNA, 670 bp, Homo sapiens
  misc_feature: GZ8MTXP02GXC22.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnaggagggtccaccatccttcttgttctggaagctatgtaccaacatacggaagtgaataagtgtatactcggtaccagctacgttacccaaggacgcccggacccccaagtcctcctactactctaataagtaaattatacggaaaccccgtcctacgacggggtccctagaccgttattctcgtggcctaccgtaagtcgtcggccctaccctcacgtccctccgtcggcccatccgaggtccggggtcccgtcccggggtaccggaagggtacgtgggacggtcttaggtaactttacgttacgttggttaggttagggaggttcgggaacgaggtcgtaacggtcccgtggtaacgttcggtacgtttagttccgttaccggtttaccgggaacggtacgggtaacccgtaccgggtccgtaaccccggttccgtacggtaccccgg

SEQ ID NO: 335924 - DNA, 748 bp, Homo sapiens
  misc_feature: GZ8MTXP02JJQVP.2.49.E05.1.454.CMB.2.raw
  modified_base (223)..(223): a, c, t, g, unknown or other
  misc_feature (223)..(223): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtctcgggtacccccgggnaggacggtccacctatcttcttgttctggaagctatcgtaccaacagtacggaagtgaattaagtgtacttacgtcggtaaccagcctacgttaccgaaaggacggcccggacccccaaagccctacctacattactaataaagtaaattacgtacgtaaccccgttcctacgtacggggtccctacggaaccgtattccgtcgtggtccctaccgtaagtccgtcgaccctaccctcgacccgtccctacccgtcggaccctagtccgtacgggttcgggtaccccgttcccgggtacggaaagggtcgtacgggaacgggtttagttacggttaacttttacggttacgttagggtttaggggttaggacgggttacgggtaacgacgtaccgtacggtacggttaggtaccggtttgttaacgttttacggtaccggttacccgggttaaccgggtaaccggttaccggggtaaccccgttaccgggttacccgtaaccccggttaccgtaacggtaccccg

SEQ ID NO: 335925 - DNA, 719 bp, Homo sapiens
  misc_feature: GZ8MTXP02GBK8A.2.49.E05.1.454.CMB.2.raw
  modified_base (221)..(221): a, c, t, g, unknown or other
  misc_feature (221)..(221): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtctcgggtacccccggnagacgggtcaccatctcttgttcaggagcatcgtaccaacagtacggaagtgataatgtatacgtggtaccagcacgtaccaagacgcccggacccccaagcctcctacatactaataaagtaaattagtacgaacccgtcctacggtacggggtcccctagaccgtattccgtcgtggtacctaccgtaagttccgtggaccctaccctcgaccgtccccgtcccgtacggaccctattcccgagggttccgggtacccgtacccggggttaccgggaaagggtacgtacgggtaacgggtcttaacggttaatttaacgttaacgttgggttagggttgggaagtcggggaacaggtaccgtaacggtcccgttagggtacggttacgttaccgtttagttccggtttccgttaaccgtaaccggtaaacccgggtaccgggggtaaaccccctaccgggggttaaccctaccccgggtttacggttaacccgggg

SEQ ID NO: 335926 - DNA, 755 bp, Homo sapiens
  misc_feature: GZ8MTXP02GAAFZ.2.49.E05.1.454.CMB.2.raw
  modified_base (220)..(220): a, c, t, g, unknown or other
  misc_feature (220)..(220): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnagaggtcaccatctcttgttcaggaagctatcgtaccaacagtacggaagtagataatgtatacgtcggtaccagcacgttaccgaagacgccggaccccagtcctcctctatactaataagtaaattatacggtaacccgtcctacgtacggggtccctaggaacctcttcctcgtcggtaccttacccgaacgttcgtcgggaccctacccgttccgacccgtcccccgttacccgtccgggtaccctaacgttccggtaacggggttcccgggtaccccgggttaccccgggggtacccgggtaaagggtaccgggtacgggtaaccgggtttaccggtaaggtttaaaccgttttagtttaacccgtttgggtttacgggtttaggggtacggttacggggaacgtagggcccgtaaaggtcccgtaggtaggttcgtacgtttacgtacggtttccggttaaccgggaacggtacccggggtaacccgttaaccgggtcccgtacccggttaccgttaacgggtaacccg

SEQ ID NO: 335927 - DNA, 707 bp, Homo sapiens
  misc_feature: GZ8MTXP02FOCW6.2.49.E05.1.454.CMB.2.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagcccaccctcagcgtctcggtacccccgggnaggacgggtcaccatctcttgttcnggaagcatgtaccaacagtcggaagtgaataatgtatactggtaccagacacgttacccaagacgcccggacccccaagcctccctacatctaataagtaaattagtacgtaacccggtccctacgacggggtccctggaccgtacttcgtcgtcggtctacccgaagttcctacgggcctaacccttccgaacccgtccccttcccgtcggaccctaacgtccgaacgggttcggggacccgttccccgggggtaccggaagggtaccgttagggacggtaccgttaggttaagtttagtttaacccgttgggttcggtttggggaagtacggggaacgacggtaccgaacggtccgttaggtaacggttgttaccgtttagttcggttaccgtttaccgggaaacggtttccggggaacccctacggggttaccctacccggttaccggtacggtacccg

SEQ ID NO: 335928 - DNA, 692 bp, Homo sapiens
  misc_feature: GZ8MTXP02G2RPC.2.49.E05.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcgagggtcctgggcccagtctgtgctgactcacgccctaccctcagccgttccgtccgggtaccccccggggnaggtacgggtccaaccgtnttccttctttgttcgtgggaaacncagtcgtaccaacgagtacggaagtgaataatgtataccgtggtacagtctacgttacccaaggacggccccggacccccaagtcctacctctaatctaataagtaaattagtacggaaccccgttccgacgtacggggtcccctaggacccgttattccgtaccgtcggtcctaacccgtaagtcctacggccctaaccctcgaccgtccctcccggtgccctagtccgtaggtcgggtacccgtccggtacggagacgttggacgtctagttatttaagtccgttggtggttaggacgtggaaccgtagacgtacgtccggtgtacgttacgtcgtttaagttccggttacggtttaccgggaacggttccggtaaaccgtccggttacccgacccggttaccgtacggtaacccg

SEQ ID NO: 335929 - DNA, 677 bp, Homo sapiens
  misc_feature: GZ8MTXP02IH9T4.2.49.E05.1.454.CMB.2.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtctcgggtacccccgggnaggagggtcaccntctcttgtctggancatgtacaactatacggaagtgaataatagtatactaggtaccagcctacgttacccaagcgacccggaccccccaagtcccttacctcctattacctaaataacgtaaaattacgtacggtaacccggttaccctaccggtacggggtcccctaggtaccgtacttccgtcgtggtccctaccgtaagtccgtacgggcccacctcaccgtccctcccgtcggacccagtccgtaggtcggggtcctacccgggtccgagggtacgttggacggtacttaggttactttacgttacgttggttgttgggagtacgggacagggccaggtccgtagtagtacgtacgttagttcgttacgttaacgggtaaccggttacgggaaccccgtacgggtacccgtaccccgttacggtacgggtaaccccg

SEQ ID NO: 335930 - DNA, 697 bp, Homo sapiens
  misc_feature: GZ8MTXP02FYL7S.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctccctcaccctcctcactcactgtgcagggtcctgggcccagtctgtgctgactcagccaccctcagcgtcgtcggtacccccggagaggtcaccatctcttgttctggaagcatcgtaccaacagtcggaagtgataatgtatactggtaccagcacgtccaagacgccggacccccaagcctcctcatctaataaagtaaattataggaacccggtcctacgacggggtccctagaccgtattccgtcgtcggcctacccgaagttcgtacgggaccctacctcaccgtccctcccgtcgtcccagtccgaggtcgggccgtacccgggtccgtaagggacgtacgggacgtcgtagtaacgtttacttaaccggttgggttaggttgggtaacgtacggggtaacgtaacgggtacgtacccggttaggtaaggtttcggtacgttttaacgttcggttaaccggtttaccggggtaaaaccggttccgggggtaaaccccgtaccggggttaaccccgtacccccgggtttaccgttaccgggttaccgaaaccccggg

SEQ ID NO: 335931 - DNA, 725 bp, Homo sapiens
  misc_feature: GZ8MTXP02H67SL.2.49.E05.1.454.CMB.2.raw
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (537)..(537): a, c, t, g, unknown or other
  misc_feature (537)..(537): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcaggtcctgggcccagtctgtgctgactcacgccaccctcagccgtcgtcggtaccccggcaggaggtcacctatctcttgtctggancatcgaccaacagtacggaagtnaataatgtatacgtggtaccagtcacgtaccaagacggcccgaccccancctcctacatctaataaagtaaattagtacggaacccgttccgtaccgtaccggggtcccctacggtaccgtactttcgtccgtcggtcctaccgtaacgtccgtacggccctaacccgtcgaccggtccccttccccgaccggtcctaacgtaccgacgggggtttccgggccccggtttcccggggaccgtaggggaaacgtttcgggaacgggttnttacggtaaagttttacgttaacgttgggtttagggttacggagggttcgggaacaggccgtacggtaccggttaggttggttccgtacttttacggtcccggtttacggttaccggggtaacggttaccgggggtaaaccccgttcccggggtacctacccccgggtttacgtaaccggtaacccgg

SEQ ID NO: 335932 - DNA, 623 bp, Homo sapiens
  misc_feature: GZ8MTXP02HCO6Q.2.49.E05.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
tcagacgctcgacacacgaccggtgctcgatttagagcgactagcaacacacaaagggggccccagccctgggattcccagctgtttctgcttgctgatcaggactgcacacagagaactcaccatggagtttgggctgagtctgggttttccttgttgctaattttaaaaggtgtccagtgcgaggtgctgctggtggagtccggggagcttagtcagccgtgggggtcctgagactctcctgtgcngcctcgtgtattcaccttnagtcgctacnggtatcgctacgtcggtcccgacgtaaaggtccgaggggaacgggtctaggaggtggtactacgacggctagttgaactcctagtcccgtaggggaaattagggtaaactttaaacgaccggcgtccgtccgtaggaccggggtcacgttccactagtacccaccaaganacccgaacnccgtaagaaaccncgtctagtaacnctaaagggtaaactgaacgtctagttcaacgaaggcggagaacgggtcaacgggttcgtttagtttacacgagactaacgaaggtcgtacggtacggtacggaataaccgtcgtaaacggtcggtacggacgtacggtatag

SEQ ID NO: 335933 - DNA, 687 bp, Homo sapiens
  misc_feature: GZ8MTXP02HGMTL.2.49.E05.1.454.CMB.2.raw
  modified_base (227)..(227): a, c, t, g, unknown or other
  misc_feature (227)..(227): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctcgggcccagtctgtgctgacctcacgcccacccctcagccgtctcgggtaccccccgggnaggacgggtcaccatccttcttcgttctggaaagcatcgtacccaacagtacggaagtagaataacgtgtactaacgtggtaacccagtacacgttacccgaaagacggccccggacccccaagcctcctacactactaataagtaaattagtacgaacccggtcctacggtacggggtccctacgtaccgttacttcctcgttcggtacctaccgtaagttccgtcgggccctacccgtcgacccgtccccgtcccgtcggccctagtccgtacggggtcggtcccggtcccgggtaccggaggacgttgggacggttcgtagttacgtttaacgtttacgtggttagggtttaggagttacggggaacgtacggaccgacgtaccgtggtagtcgttacttagttccgttacgttacgaacggtacggaccgaccgtccgaccgtccgtacggacccg

SEQ ID NO: 335934 - DNA, 700 bp, Homo sapiens
  misc_feature: GZ8MTXP02G4O3Y.2.49.E05.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcgagggtcctgggcccagtctgtgctgactcacgcccaccctnacgccgtcgtccgggtacccccgggnaggacggtccacctattcttcttgttcgtaggaacgctagtcgtaacccaaactagtacggtaagtagtaataagttagtaactacgtacggtaccacgtacgtacgtacccgaagtaccggcccggacccccaagtcccctcctactaatacttaaagtaaacgtaaatttacgtacggtaaccccggttcccgtacgggtaaccggggttcccctacggaaccgttacttccgtcgtcgtacctacgacgtcgtacgaccctacctcgacccgtccctcccgtcggtaccctagtccggacgggttccggacccgtcccgggtacgaaggtcgtggacgtctagtacgttgttacgtgttggtagaggtcggactacgcgtacggtcgtaggtacgttcgttatttacggtcgttacgttaaccggaacggtaccgtaccgtacgtcccggtacgtaccggtacgtacccg

SEQ ID NO: 335935 - DNA, 637 bp, Homo sapiens
  misc_feature: GZ8MTXP02FLY3Y.2.49.E05.1.454.CMB.2.raw
  modified_base (219)..(219): a, c, t, g, unknown or other
  misc_feature (219)..(219): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcggtacccccgggnaggaggtcaccatctcttgttctggaagcatgtccaacatacggaagtgataatgtatacgtgtaccagcagttcccaagacgccggaccccaagcctcctacatctaataagaaattagtacgaacccgtcctacgaacggggttccctaggacccgtatttccgtctcggccttacccgtaagttcgtcgggacccacccgttccgacgtcccctcccgtcggccctatccgaggttcggggccttacccgggtaccgaggtacgtaggacggtcgtaggtaactttaacgttacgttggttaggtttggtaggtcggggaactaggcgaacggtcccgtaggtacggttgtacgtttagttcgttacgttacggaacgtacgggtaccacgggtccaccggtccgttacggaccg

SEQ ID NO: 335936 - DNA, 568 bp, Homo sapiens
  misc_feature: GZ8MTXP02JP0XA.2.49.E05.1.454.CMB.2.raw
  modified_base (317)..(317): a, c, t, g, unknown or other
  misc_feature (317)..(317): n is a, c, g, or t
  modified_base (497)..(497): a, c, t, g, unknown or other
  misc_feature (497)..(497): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtaccccccgggcagagggtcaccatctctgttctggaagcatgtccaacatcggaagtgataatgtatactggtaccagcagttcccaagagccggccccaagctcctnatctataacgaaattgtgaaccccggtcctcgacggggttcccctgacccgatttcctcgtgggcctccaaaggttcctcgggcctacctccagccctccctggcccattccaggtcggggcttcccgggtacgacggatggaggctagactttaattccgtgtcggttggatggggacngcacgtctgtacgtcgtcttagtcgttacgtaccggaacgtcggggaccacggtccacccgtcgtacggtc

SEQ ID NO: 335937 - DNA, 753 bp, Homo sapiens
  misc_feature: GZ8MTXP02FUWJ2.2.49.E05.1.454.CMB.2.raw
  modified_base (450)..(450): a, c, t, g, unknown or other
  misc_feature (450)..(450): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagcgtcgtcggtacccccgggcagacgggtcaccatctcttgttctaggagcatcgtaccacagtacggagtgatatagtatacgtcggtaccagcctacgtacccgaagcgcccggacccccaagtcctccctatactacttaataaagtaaatttagtacgtaacccgtcctacggacgggttaccctacgaacccgtacttccgtcgtcggtaccttaccgtaacgttccgcggtacccacccgttnaacccggttcccctcccgtacggaccctagtacccgtaggggtcccgggtcccgttacccccgggacgggtaaaggtacgttcgggaaccgttgttaaacgggttattttaaacgtttccgttgggtttagggttaccggtaaagggttcgggtaaaacccggtcggtaccgtacggtaccggttaggttacgttaccgtttacggtttacggtttaccggttaccggttaaacccggggtaacggtacccgggtaacccgtacccgggttacccgtacccgttaaccgggtacggtaacccg

SEQ ID NO: 335938 - DNA, 721 bp, Homo sapiens
  misc_feature: GZ8MTXP02FKG6H.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctcgggtacccccgggcagagggtcaccatctcttgttctggaagcatgtccaacatcggaagtgataatgtatactggtaccagcagttcccaagacgccggacccccaagcctcctcatctaataagaaattatagaaccccgtcctacgaggggtccccctaggacccgtatttcctcgtcggtcctacccgaaagtctcgggaccctaccctcgaccgtccctaccctcggccctagtccgtagggttcgggggcccttaccccggggtacccgaagggtacgttacgggacggtccgttaggttaattttacgtttaaccgttggtttaggtttcggggtaaggttacgggggaacctaacgggcccgtaacggtcccgttagggtaaacgttcggttaaccttttaaggtttcggttacccggtttaccggggtaaaaccggttccgggggtaaccccgttacccggggttacccgttaaccccggtttacccggttaacggggtaaccccg

SEQ ID NO: 335939 - DNA, 746 bp, Homo sapiens
  misc_feature: GZ8MTXP02JAZ5W.2.49.E05.1.454.CMB.2.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctnagcgtctcggtacccccggnaggaggtcaccatctcttgttctggaagctatgtaccaanagtcggaagtgataatgtatacgtgaccagctagtcccaagcgcccggcccccaagcctaccgtactataccttaagtaagtaaatttagtacggtaaaccccggtccctacggtacggggtccctgtacccgtattcctcgtcggactaccgtaagtcgtaggaccctacctcgaaccgtcccctcccgtacggccctagtccgtacgggtcggggtacccgtacccggggtacccggtaaagggtacgttgggaacggttccgttaacgggttacttttaaccgttaccgttgggtttacgggtttaggggtaacgttcggggaaaccgtacgggtcctaacgggttccctaagggtaccggtttagttaccgttttaagttaccgggtttaccccggtttaaacggggtaacccgggttaccggggtaaccccgttaacccggggtacctaacccccgggttaccgtaacccggtttaacccggg

SEQ ID NO: 335940 - DNA, 654 bp, Homo sapiens
  misc_feature: GZ8MTXP02HNRQD.2.49.E05.1.454.CMB.2.raw
  modified_base (224)..(224): a, c, t, g, unknown or other
  misc_feature (224)..(224): n is a, c, g, or t
  modified_base (526)..(526): a, c, t, g, unknown or other
  misc_feature (526)..(526): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcacccctcctcactcactgtgcagggtcctgggcccagtctgtgctgactcacgcccaccctcagcgttcgtcgggtacccccgggnaggacggtcacctatctcttgttcgtggaagcatgtaccaaacatacggaagtgaataatgtatactggtaccagtcacgttacccaagacgccccggaccccaagcctcctacatctaataaacgtaaatagtacgtaacccggtcctacggtaacggggtccctagtaacccgtactttccgtcgtcggtacccttaccgaacgttcgttacgacccaacccgtccgaacgtccccctcccgtcggaccctacgtccgacgggttcgggccctccggggtaccgaggactgggaacggtnttagtattacgttggtgttaggtggtaggtaggacacgtcgacgtcgtaggtgttacgtacttacgtcgttaccggtaggtaaccgtcgggaaccctaccggtacctacccggtacgtacggtacccg

SEQ ID NO: 335941 - DNA, 575 bp, Homo sapiens
  misc_feature: GZ8MTXP02JAWWK.2.49.E05.1.454.CMB.2.raw
  modified_base (340)..(340): a, c, t, g, unknown or other
  misc_feature (340)..(340): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccccgggcagagggtcaccatctcttgttctggaagcatgtccaacatcggaagtgataatgtatactggtaccagcagttccccaaagacgccggccccccaagcctcctcatctaatagtaaattancgaaccggtccctcgacggggtccctagtacccgattctctggcctaccaagttctggcaccctcacgtccctcccgtggccctagtcccgaggtcgggcctcccgggtccgagggtactggacggtctagtatttattacgtgttggttagagtgggactagcgagccgtagcgtgtcttatcggtcgttcggaacgtcgggaccgtacggtccgtaccgtccgtacggtaccg

SEQ ID NO: 335942 - DNA, 731 bp, Homo sapiens
  misc_feature: GZ8MTXP02IKZB8.2.49.E05.1.454.CMB.2.raw
  modified_base (225)..(225): a, c, t, g, unknown or other
  misc_feature (225)..(225): n is a, c, g, or t
tcagacgctcgacacacgaccggtgctcgatttagagcgactagcaaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtcgggtacccccgggnaggacggtccaccattctcttgtctaggagctatcgtaccaaactagtacggaaagtgaataatgtaatacgtacggtaacagtctacgttaccccaaaggacgcccggacccccaagtcctccctatacttacgtaataaaagtaaattaacgcgtaaaaccccggttcctaccgtacggggtacccctggtaacccgtattccgtacgtcggaccctaccgtaaagttccgaggaccctaccctagacccgtccctcccttcgggacctagtccgaagggtccgccgttacccggcgaaggtacgtggacggtacgtattaacgtttaattacgttaggttcggttagggagttaccggggagtacgacgtacggtacgtacggtaacgtggttaaccgttttagttacggttaaccgttaccgggtaaaccgggttacccgggaaaaccgtttaacccgggacccggtttacccgttaaccggggtttaaacctaaacccggg

SEQ ID NO: 335943 - DNA, 699 bp, Homo sapiens
  misc_feature: GZ8MTXP02FM54F.2.49.E05.1.454.CMB.2.raw
  modified_base (218)..(218): a, c, t, g, unknown or other
  misc_feature (218)..(218): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccacctcagcgtctcggtaccccccggnaggacgggtcaccatctcttgttcgtggaagcatcgtaccaacatacggaagtgataatgtaatactaggtaccagctaacgttaccccgaaagacggcccggacccccaaagcctcctacatactaataagtaaattatacggaacccgtcctacgacggggtcccctagaccgactttcgtctcgggtccttaccgaagtccgtcggtaccaacccttcgaccgtcccctcccgtacggccctaacgtccgtacgggttcggggtcccgtaccccggggtaccggaaggtacgtaggaacgggtctacgttaatttaagttaccgttgggttacgttaggggtaaggttcggggaaactaggacccgaaggtcccgttaggtaagtcggttactttaacgtcgggttacgtttacccgggaaacgttcggggaaacccgtaccggttacccgtaaccggttacccggtaaggtacccgg

SEQ ID NO: 335944 - DNA, 809 bp, Homo sapiens
  misc_feature: GZ8MTXP02GWIZ0.2.49.E05.1.454.CMB.2.raw
  modified_base (224)..(224): a, c, t, g, unknown or other
  misc_feature (224)..(224): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagtcgtccgtcgggtacccccgggnaggtacgggtccaccatcttcttcgttcgtagggaacgtctagtcgtacccaaacgtagtacggaagtgtaattaagtagtaattacgtacggtaaccaggtacctacgttaccccgaaaggaccggtaccccggaccccccgtaaagtccccttacctacctaacttaccttaaagtaaaaggttaaaactttacggttaacggtaaaccccggggttcccctacgggtaaccgggggttccccctacggtaacccgttacgttcccgttccgtcgggttaccctaccgtaacggttcgttaccgggaccctacccgtcgtacccgtcccctcccgtacggccctacgtccggtacgggttccggggtacccgtcccgggtaccggtaaagggtcgtcgggacgggtcttacggttaatttttacgacgttgggtagggtttggaaacggttcggggaactacggctaccggttacgtaggtcgttacggtacttttcggtaccgttaccggtttacgggaaccgggttacgggaaaccccggttccggttaccgtacccggttacggtaaaacggggtccccg

SEQ ID NO: 335945 - DNA, 766 bp, Homo sapiens
  misc_feature: GZ8MTXP02FKR4R.2.49.E05.1.454.CMB.2.raw
  modified_base (260)..(260): a, c, t, g, unknown or other
  misc_feature (260)..(260): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatcgtaccaacancggtaagtgataatgtatactggtacctagcacgttaccaagagccggacccccaagcctcctcactctaataacgaaaatttatacggaacccggtcctacgacggggtcccctaggtacccgtatttctacgtcggccttaccgaagttcgtacgggcctaccctacgtaaccgtccctcccgtcggaccctacgtacgtacgggtaccgggtcccgttccccggggttcccggaaagggtacgttacgggacgggtaccgttaggttaaaactttacgtttaaccgttgggtttaggggtttaccgggtaaagggttcgggggaaaccgttacgggtaccggaaccgggtacccggttagggtagtttaacgggttacccgttttaaaagttcggtttacccgggttttaacccggggaaacccggttaccgggggtaaacccccgtaaccggggttaaccccgttaccccggtttacccggtaaccggtttaaacccccggg

SEQ ID NO: 335946 - DNA, 852 bp, Homo sapiens
  misc_feature: GZ8MTXP02JL0YZ.2.49.E05.1.454.CMB.2.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcgagggtcctgggcccagtctgtgctgactcacgcccaccctcagccgttccgtcgggtaccccccgggnaggacggtccacattcttcttgttctggaagcatcgtaccaanagtacggaagtagataatgtactacgtacggtaccagctacgttcccgaaaggacgcccggacccccaagtcctaccctactattactaaataaagtaaattacgtacggtaaacccccggtcctacggtaccggggtaccctcggaacccggttactttccgttccgtacgggtcccttacccgaagttccgtacgggacccctacccgtacgacccgtcccccgttcccgtccgggtaccctaacgttcccggaacggggttccgggggtacccccgttcccgggggtaacccgggtaagggtaggttaaccggggtacgggtcccgtttaagggttaaaccgtttttaaagtttaacccgggtttgggggtttagggtttacgggggtaacggtttaccgggggaaaccgtaccgggtaaccggtaaccggtcccggtttaggggaaaccgggtttcgtttacccggttttaagtccgggttttaacccggtttaaccggggaaccggttacccgggggaccccgttaccgggttaccccggtaaccccggtttacccggtttaacgggaacccccgg

SEQ ID NO: 335947 - DNA, 705 bp, Homo sapiens
  misc_feature: GZ8MTXP02ITIJD.2.49.E05.1.454.CMB.2.raw
  modified_base (269)..(269): a, c, t, g, unknown or other
  misc_feature (269)..(269): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgcccaccctcagccgtcgtccggtacccccgggcaggacgggtcaccatcttcttgttcgtaggaagcatcgtaccaanagtacggaagtgaataatgtaatcgtaggtaccagtctacgttaccaaggacgcccggaccccagtcctcctactatactaataagtaaattagtacgtaaccccgtcctacgacggggttcccctaggtaccgtacttctcgtcgcctaccgtagtcgtacggcctaccgtcgaccgtccctacccgtcggtaccctagtccgtacgggtccgggtacccgtacccgggtacggtagggtaacgtcgggaacgggttcgttacggttaacgtttaccgtttaggtttggttacgggttagggtaaggttcgggaacgtacgacgtacggtcgttaaggtcgttacgtcgtttacgtccgttacggttaccgggtaacggtaccggggtaacccgtaccgggttaccggtaccccgttacggttacccggtacccg

SEQ ID NO: 335948 - DNA, 699 bp, Homo sapiens
  misc_feature: GZ8MTXP02J29EK.2.49.E05.1.454.CMB.2.raw
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
  modified_base (485)..(485): a, c, t, g, unknown or other
  misc_feature (485)..(485): n is a, c, g, or t
  modified_base (552)..(552): a, c, t, g, unknown or other
  misc_feature (552)..(552): n is a, c, g, or t
  modified_base (596)..(596): a, c, t, g, unknown or other
  misc_feature (596)..(596): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctccctcctcaccctcctcactcactgtgcgagggtcctgggcccagtctgtcgactgactcacgccaccctcacgccgtctcgggtacccccgggnaggacggtaccaccattccttcttgttactaggaancctatcggtacccaaagacgtacggtaaagttgaacttaaagtgtactacgtacggtaccagacctacgttacccaaggaccgccgaccccaagcctccatactactaactaagtaaattacgacgtaaccccggtcctacggtaccgggtacctacgacccgttattccgtacgtccggtccctacgtaaacgtcgtcggtacccaacccgtccgtacccnccccgttaccgtcggaccctacgtcgtacggttcggcccggtaccggtcggaggagtcggtacggtnttagtacgtttactagttcggttacggtaggtacggtacggacncgtacgtacggtcgtgtacgttcgtacgtttacgtccggtttaacggtacccggtaaccggttcgggaccgtaccggttaccgtacccggttacgacgtaccg

SEQ ID NO: 335949 - DNA, 709 bp, Homo sapiens
  misc_feature: GZ8MTXP02IQ28S.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttcccctctcctcctcaccctcctcactcactgtgcagggtcctgggcccagtctgtgctgactcacgccaccctcagcgtctcggtaccccggcagacgggtcaccatctcttgttctggaagcatcgtaccaacatcggaagtgataatcgtaatactggtaccagctaacgtccgaaagaccggcccgacccccaagtcctccctacctataccttaaagaagttaaaattagtacgtaaccccgggttaccccgtacgggacggggttcccctacggaccgttactttccgtccgtcggtacccctacgtaacggttccgtacggccctacccgtactcccggtcccctcccgtcgtaccctacgtcggtcgggttcccgggcccggtaccccgggttcggaagggtaacgtcggggtaacgtcgttaacggttactttacgtttacgttgggtttggtacggtaagtcgggacagtccgtacgtcgtggtaacgtccgttatttacgttccgttacggttacggaaccggttcgggtacccggaaccggttcccgaccggttaccgttacggaaccccgg

SEQ ID NO: 335950 - DNA, 727 bp, Homo sapiens
  misc_feature: GZ8MTXP02HN0FE.2.49.E05.1.454.CMB.2.raw
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctcgggcccagtctgtgctgactcagccaccctcagcgtctcggtacccccgggcaggagggtccaaccattctcgttgttctaggaacgcatcgtaccaaacgagtcggaagtgaataatgtaatactggtaccagacacgttacccaaggacgcccggacccccaagcctacctactactacttaataaagtaaaattacgtaacggaaccccggttccctacgggtacgggggttccccttacggaacccgttatttcccgtcgttacggtcctacccgtaagttccgtcggaccctaacccgttcgaacccgtcccccgtaccccgtcgggtaccctacgttccgaaacggtcccgggggtccgtacccggggtacggaacggtaagtggaacggttctaggttaatttaacgttaggtcgttaggtcgggtagtaccgggggacaggtaccgacggtccgtgggtacgttacggtactttacgttcgttacggttaccggtaaccggtcggtaacccggtaacggttccccgacccgttacggttacggggtaaccc

SEQ ID NO: 335951 - DNA, 736 bp, Homo sapiens
  misc_feature: GZ8MTXP02G2B1Z.2.49.E05.1.454.CMB.2.raw
  modified_base (228)..(228): a, c, t, g, unknown or other
  misc_feature (228)..(228): n is a, c, g, or t
  modified_base (519)..(519): a, c, t, g, unknown or other
  misc_feature (519)..(519): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtccgtcgggcccagtctgtgctgactcacgcccaccctcagtccgtcgtccgggtacccccgggnacggacgggtccacctatcttcttgttcgtaggaacgcatcgtaccaactagtacggaagtgtaataagtgtaacttacgtacggtaaccagtacctacggttaccccaaaggaccggcccccggtaccccccgaaagtcccttcctaccctattacctaaagtaaagtaaaactttacgtacggtaaccccggttccctacggtaccggggtccctacggtacccgtacttccgtacgtcggtcccttacctaacgtccgtacggaccctacccgttcacccggttcccncccgtggaccctagtccgaggtccgggtacctccgggtacgagggtctaggagtcgtatttacgttagttacgttgggttgtacggtacggtcggaacgcgtacggtcgtaccggttggtaaccgtgttaaccgttagttaccgttcccggttaacggggtaaccgtccgggtaaccctaccggggtaccttacccgggtaccgtaacggtaccccg

SEQ ID NO: 335952 - DNA, 659 bp, Homo sapiens
  misc_feature: GZ8MTXP02HRMU3.2.49.E05.1.454.CMB.2.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (328)..(328): a, c, t, g, unknown or other
  misc_feature (328)..(328): n is a, c, g, or t
  modified_base (448)..(448): a, c, t, g, unknown or other
  misc_feature (448)..(448): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcacccctcctcactcactgtgcgagggtcctgggcccagtctgtgctgactcacgcccaccctcagccgtctcggtaccccggnaggaggtcaccatctcttgtctggaagcatcgaccaacngtacggaagtgaataatgtatacgtgtacagctacgtacccaaggacgcccgaccccaagcctccnctatctaataaactaaattacgtacggtaaccccgtccgtacggtacggggtcccttagacccggttattccgttcgtcgggtaccctacccgtaacgtccgtcggaccctacccgtacncccgtccccgttcccgcgaccgttacgtcggacggttccggcccgttaccgggacgtagggtatcggacggtctagttactttaagtgttggtacggttaggaggtacggactacggtcacggtacgttaggtgtacgttacttacggttccgtacggttaccggggaacgtaccggacccgtacgggtaccctaccgtaccgtaacggcg

SEQ ID NO: 335953 - DNA, 779 bp, Homo sapiens
  misc_feature: GZ8MTXP02JV5FZ.2.49.E05.1.454.CMB.2.raw
  modified_base (227)..(227): a, c, t, g, unknown or other
  misc_feature (227)..(227): n is a, c, g, or t
  modified_base (526)..(526): a, c, t, g, unknown or other
  misc_feature (526)..(526): n is a, c, g, or t
tcagacgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcgacggtccgtgggcccagtctgtgctgactcacgcccaccctcagccgttccgtccgggtacccccggnacggacgggtaccacctattccttcgttgttcgtaggaacgctatcgtaccaaacagtacggaagtagtaataagtagtaacgtacgtacggtaaccagtctaacgttacccgaaacggaccggccccggacccccaagtcccttacctactaattacctaataaagtaaattacgtacggaaccccggttcccgtacggtaccggggttacccctacggtaccgtactttccgtacgtacggtaccctaccgtacgtcgtaccgccctaacccgttccgacccgtccccgttacccgnggtccctacgttccggacgggttccggggtacccgttccccggggtaacggtagggtaccgttggggaacgggttcttaacggttaacttttacgttaccggtttggggtttcgggttagggacgggttacggggaactccgggacgtaccggtacgttggtacggttccgttagtttcgcggtttacggtaaaccgggtaaccggaccgggtacccgtacggtcctaacccggttaccggtaacgtaccccg

SEQ ID NO: 335954 - DNA, 785 bp, Homo sapiens
  misc_feature: GZ8MTXP02GIMS3.2.49.E05.1.454.CMB.2.raw
  modified_base (512)..(512): a, c, t, g, unknown or other
  misc_feature (512)..(512): n is a, c, g, or t
tcagacgctcgacacacgaccggtgctcgatttagagcgactagcaacacacgaaaggggggggaagctcagcttcagctgtggtagagaagacaggattcaggacaatctccagcatggccggcttccctctcctcctcaccctcctcactcactgtgcgagggtcctgggcccagtctgtgctgactcacgcccaccctcacgcgtcgtccgggtaccccggcgaggacggtccacctatcttcgttgttcgtaggaagtctaacttcggtacccaaacgtagtacgggtaaagtagaaattaaagttggtaactaaccgttacgggttaacccaacggtaccgttaaaccggttaccccgaaaaggacccggacccccggtaccccccctaaaaggtccccttaccctactaacttaccttaaaagtaaacgtaaaattacggtaaccggtaacccccggttacccgttaccggggtaccggggttcccctaacgggtaaccccgtttntttcccgttacgtccgggtaccttaccgtaacgtcgtcggaccctacctcgtacccgtccctccgtacgccctaacgtccggtaggtccgggtacccgttacccggggacgtaacggagtcgggtagtccgtagttacgtttattacgtggttggttacggaagtcggacgtacgacgtacgtccgtaaggtcgttcgtacgtttacgtacggttacgttacgggaacgtaccgggtacgtacccggtcgtaaccggtccggtaacggacccg

SEQ ID NO: 335955 - DNA, 839 bp, Homo sapiens
  misc_feature: GZ8MTXP02GXG6Q.2.49.E05.1.454.CMB.2.raw
  modified_base (225)..(225): a, c, t, g, unknown or other
  misc_feature (225)..(225): n is a, c, g, or t
tcagacgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcacgccaccctcagccgttcgtccgggtaccccccggnaggacgggtccaacctagtccttcttgttctaggaacgtcaatcgtaccaactagtacggaagtgataatgtatactaggaccagctacgtccaagcgccggaccccaagtctcctcattacctaataaacgtaaatttacgtacgtaaaccccgggttcctaccggtacggggttcccctacggtaccgtactttcgcccgttcggtacccttacccgtaaacggtcccggttcggaccccgttaaacccgtaccgtacccgtacccccgttcccccggtcggtaccccgtaacgttaccccggtagggggtttcccggggtaccccggttacccccgggggtaccggtaaaaccggggtggttaccggggtaacggggttccgttaacgggttaactttttaacgttaacccggtttggggtttagggtttaccgggaagggttacgggggtaaaacccgtcgggggacctaacggtccccggtttaaagggccggtttaaaccgtcgttttaacgggttccgttaacccgggttaccgggtaaaccggttaccggggaaccccgttaccgggtaaccccgtacccggttaccggttacccgggtaaccccg

SEQ ID NO: 335956 - DNA, 619 bp, Homo sapiens
  misc_feature: GZ8MTXP02IB6WC.2.49.E05.1.454.CMB.2.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
tcagacgctcgacacacgaccggtgctcgatttagagcgactagcaacacacaaaggggggggaagctcagcttcagctgtggtagagaagacaggattcaggacaatctccagcaatggccggcttccctctcctcctcaccctcctcactcactgtgcagggtcctgggcccagtctgtgctgactcagccaccctnagcgtctggtacccccgggagaggtcacntctnttgtnaggancatcgtcaanagcgagtnatatgtatacgtagtacagactacgtaccaagacgccgaccccagtcctcctcactactaataagtaaattagtacgtaaccccggtccgtacggtacgggtccctagtaccgtacttcctcgtcgtcctacgtacgtcgtcgcctaccctcgaccgtccctccgtcggacctacgtcgaggtcggccgtcccggtcgaggtagtcggacgtactagtactttagttcgtaggttcggtggacgtacggacgacgcgtacgtacgtgtacgttcgtactttacgtcgttaccgttaccggtaaccggtacgggtaaccccgtaccggtcccgttaaccccggttaccgtaacggtcccg

SEQ ID NO: 335957 - DNA, 659 bp, Homo sapiens
  misc_feature: GZ8MTXP02JBFXT.2.49.E05.1.454.CMB.2.raw
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (452)..(452): a, c, t, g, unknown or other
  misc_feature (452)..(452): n is a, c, g, or t
tcagacgctcgacacacgaccggtgctcgatttagagcgactagcaacacacaaaggggggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccggnagaggtcacatctcttgtctggacgcactcaacntcggcngataatgtagtactaggtaacaagacgtaccggtacccgaaaggtaaaccctaccccccgtaaaactccctaacacgttaccttacaccaaataaaactaaatccgtacggcccggtaccccctcgacggtacgtcccgtacgaccgtaactttctctacgtcctaacccgtaagttccccgacctaccgtacnccgtcccctcgtacgacctatacgacggtcggtccgtaccgggacgtagacgtaggacgtcgtaagtaacttagttacgtgtacgagagggtaagtaggtacgtagaaccgtacggtggttacttacgttacgttcgtaccgttaccggaccggttaacggtaaccgtaacggtcttacccggtgttaccggaactaaccggacccg

SEQ ID NO: 335958 - DNA, 409 bp, Homo sapiens
  misc_feature: GZ8MTXP02FWLN4.4.29.C07.1.454.CMB.2.raw
  modified_base (405)..(409): a, c, t, g, unknown or other
  misc_feature (405)..(409): n is a, c, g, or t
tcagagcactgtagcacgaccggtgctcgatttagagtgctacgaagggaaaggggctggagtgggttggccatattaaagcaaatctgatggtgggacaatacactacgctgcacccgtgaaaggcagattcaccatctcaagagacacttcaagaaattcattgtatctgcaaatgaacagtttgaaaccgaggacacagccgtgtattatgtacagctggacactattctccctggggccagggaaccctggtcaccgtctcctcagcctccaccaagggcccatcggtctccccctggcgccctgctccaggagcacctccgagacgcacagcggccctgggcctgcctggtcaaggctacttccctacagtgctctgagcgggctggcaaggcgcatagnnnnn

SEQ ID NO: 335959 - DNA, 449 bp, Homo sapiens
  misc_feature: GZ8MTXP02HYB1W.4.29.C07.1.454.CMB.2.raw
  modified_base (435)..(435): a, c, t, g, unknown or other
  misc_feature (435)..(435): n is a, c, g, or t
  modified_base (441)..(449): a, c, t, g, unknown or other
  misc_feature (441)..(449): n is a, c, g, or t
tcagagcactgtagcacgaccggtgctcgatttagagtgctacgaagggaaaggggctggagtgggttggccatattaaaagcaaatctgatggtgggacaatacactacgctgcacccgtgaaaggcagattcaccatctcaagagacacttcaagaaattcattgtatctgcaaatgaacagtttgaaaaccgaggacacagccgtgtattatgtacagctggacactattctcctggggccagggaaccctggtccaccgtctcctcacgcctccaccaagggccccatccggtccttccccctggccgcccctggcctccaggacgccaccctccggagacgcacgagccggccctggggccctggccctgggtaccaaagggccttaccttcccctacagtcgcctcgtgacggccgggctggcaaggcncatagnnnnnnnnn

SEQ ID NO: 335960 - DNA, 725 bp, Homo sapiens
  misc_feature: GZ8MTXP01CG6JK.41.28.C06.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
tcagtctatactatcacgaccggtgctcgatttagagctcacgtattgggtttgggggggcacaagaggcagcactcaggacaatctccagcatggcctggtctcctctcctcctcactctcctcgctcactgcacagggtcctgggcccactctgtgctgacgcagcccgccctcagtgtcgtcggggccccgggnaggaggtcaccatctcctgcacgtgggancagactaccaacagtcgggacagtattcngatcgtaccacgtacggaacccaacctaccttaccgaacggaaccaccgacccccctaaactcctactacttaccgtttaacggtaaacctaacgttacgtcccgggtcccctacggtaccgggggttccctacggacctactttcccgtcgtcggcctacccgaagttccgtcgccctacctccgaccgtcccctcccgtcggccctaacgtcccgacggttccgggcctacccggaggtcgtacggaaaggtagttgggaacgggttagttaacgttacgttaccgtccgggtacccgttacgttaccctagtaccgaaccgacgaccgtacgtcccgttaggttacggggttggggtttgggggtcggttccgggggacggggtaaacggaccgtacggtcgaccggttcccgttacgggtcggtaccgaaccgacccggacggttcccgtcccggccccgttccgg

SEQ ID NO: 335961 - DNA, 660 bp, Homo sapiens
  misc_feature: GZ8MTXP01EFXVZ.41.28.C06.1.454.CMB.2.raw
  modified_base (197)..(197): a, c, t, g, unknown or other
  misc_feature (197)..(197): n is a, c, g, or t
  modified_base (448)..(448): a, c, t, g, unknown or other
  misc_feature (448)..(448): n is a, c, g, or t
  modified_base (533)..(533): a, c, t, g, unknown or other
  misc_feature (533)..(533): n is a, c, g, or t
tcagtctatactatcacgaccggtgctcgatttagagctcacgtattgggtttgggggggcacaagaggcagcactcaggacaatctccagcatggcctggtctcctctcctcctcactctcctcgctcactgcacagggtcctgggcccactctgtgctgacgcagcccgccctcagtgtcgtcggggccccgggnaggaggtcaccatctcctgcacgtgggagcagactaccaacagtacgggactagtattctgatcgtcccacgtacggacccaacctacccttaccgaacggaacccacccgaccccccaaactccctactacttacgtttacggtaaactaactacgtcccggtcccctcggacgggttcccctagacccgtattcccctacgtcgtctacccgtaagtccgtcgcccaccctcacccgtcccctccccgnggccactcgacgtcggcctcgaggtcgtagaagtagtgggagttgtaatttataccgtacggacgttacgtacctagtacgacgngtaccgacgtctcgggtaggtttgggttcggggtaacgttcgggacggggtacggaccgtagccgttccggttaccgttccggtcggtccaacggtcccgacggttccgtcccgttccccgttccgg

SEQ ID NO: 335962 - DNA, 535 bp, Homo sapiens
  misc_feature: GZ8MTXP01ER0QK.52.20.B09.1.454.CMB.2.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactatgtctcctggtaccaacaccacccaggcaaagccccaaactcatgatttangatatcagtgatcggccctgaggggtttcaatcgcttctctggctccaagtccggacaacncggcctccctgaccatcnctgggctcaggccgaggacaggctgattattatgcagntcatataacaaacaaacaaacaataggtaggttcggtcggagggacgaagaacgtgacgtccgttacgtcgacgccgacgacgtcgccccgtccggtcacttctcgttcccgtccccg

SEQ ID NO: 335963 - DNA, 351 bp, Homo sapiens
  misc_feature: GZ8MTXP01CFOCD.52.20.B09.1.454.CMB.2.raw
  modified_base (349)..(351): a, c, t, g, unknown or other
  misc_feature (349)..(351): n is a, c, g, or t
tcagcgcagtacgacacgaccggtgctcgatttagtgtagtgtgaagggccggttcaccatctccagagacaattccaacagcacgctgtatttgcacatgaacagcctgagagccgaggacacggccatatattattgtgcgacacttccttttgactggttattatcccctagtgaccactggggccagggaaccctggtcaccgtctcctcagcctccaccaagggcccatcggtcttcccctggcaccctcctccaagagcacctctgggggcacagcggccctgggctgcctggtcaaggactactccagtactctatctgagcgggctggcaaggcgcatagnnn

SEQ ID NO: 335964 - DNA, 352 bp, Homo sapiens
  misc_feature: GZ8MTXP01E1GGI.52.20.B09.1.454.CMB.2.raw
  modified_base (351)..(352): a, c, t, g, unknown or other
  misc_feature (351)..(352): n is a, c, g, or t
tcagcgcagtacgacacgaccggtgctcgatttagtgtagtgtgaagggccggttcaccatctccagagacaattccaacagcacgctgtatttgcacatgaacagcctgagagccgaggacacggccatatattattgtgcgacacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccagtactctatctgagcgggctggcaaggcgcatagnn

SEQ ID NO: 335965 - DNA, 351 bp, Homo sapiens
  misc_feature: GZ8MTXP01CGN5A.52.20.B09.1.454.CMB.2.raw
  modified_base (262)..(262): a, c, t, g, unknown or other
  misc_feature (262)..(262): n is a, c, g, or t
  modified_base (349)..(351): a, c, t, g, unknown or other
  misc_feature (349)..(351): n is a, c, g, or t
tcagcgcagtacgacacgaccggtgctcgatttagtgtagtgtgaagggccggttcaccatctccagagacaattccaacagcacgctgtatttgcacatgaacagcctgagagccgaggacacggccatatattattgtgcgacacttccttttgactggttattatcccctagtgaccactggggccagggaaccctggtcaccgtctcctcagcctccaccaagggcccatcggtcttcccctggcaccctctccaagngcacctctgggggcacagcggccctgggctgcctggtcaaggactacttccagtactctatctgagcgggctggcaaggcgcatagnnn

SEQ ID NO: 335966 - DNA, 635 bp, Homo sapiens
  misc_feature: GZ8MTXP01EL08H.52.20.B09.1.454.CMB.2.raw
  modified_base (300)..(300): a, c, t, g, unknown or other
  misc_feature (300)..(300): n is a, c, g, or t
tcagcgcagtacgacacgaccggtgctcgatttagtgtagtgtgaagggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgactagttgggtgttaataactatgtctctgtaccaacaccaccagcaaacgccccaaatcatgatttangatatcagtgactcggccctgtaacgggggtttcaactcgtcttcgtcctggactccgaaacgtccccggaaaccaaaccgaacccgggccctacccgtacgaaccctacttctccggtcggggccctacccgagggacccggaagggaaccgagggtcctaggtaatttaattagttcgacagtctacaattaacgaaacaaaacaaactaaactaaagttggggtacgttcgggacggaaacggggaccaagtccgtcgttacccgtacttagggacacggacccgaggcctccgtccccctaaggtccaccttcgttccgttccccgtcccc

SEQ ID NO: 335967 - DNA, 348 bp, Homo sapiens
  misc_feature: GZ8MTXP01BRHT0.52.20.B09.1.454.CMB.2.raw
  modified_base (255)..(255): a, c, t, g, unknown or other
  misc_feature (255)..(255): n is a, c, g, or t
  modified_base (342)..(348): a, c, t, g, unknown or other
  misc_feature (342)..(348): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatccctagtgaccacgtgggccagggaaccctggtcaccgtctcctcagcctccacaaggccatcggtctcccctgcaccctctcaagngcacctcgtggggcacagccggccctgggctgcctggtcaaggactactccagtactctatctgagcgggctggcaaggcgcatagnnnnnnn

SEQ ID NO: 335968 - DNA, 577 bp, Homo sapiens
  misc_feature: GZ8MTXP01ANDUQ.52.20.B09.1.454.CMB.2.raw
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagcgcagtacgacacgaccggtgctcgatttagtgtagtgtgaaggggagctctgggagacgagcccagcactggaagtcgccggtgtttccattcggtgatcatcactgaacacagaggactcaccatggagtttgggctgagcttgggttttcctcgttgcttcttttaagaggcgtccagtgttatgtgcagctggtggagtcgtgggggaggcgtggtccagccgtgggacgtccctgagactcgcctagtaaccgtcggattacctnagtaactngcaatgcacgtggtcccgcaggcctccgaggcgaaggggctggacgtggggngcagctatntctatttgatagggaanacaaattaaaaactacgtaacgacacgtacgtaccggtaggaacggggcctaatccaacctacttaccgaagtacgacacgctaccgaataacgacgtactatctacggacgtaatacgaactacgaccgtagacgaccgtagacggtacgacggttctttaacgttttacttggtcgcgtccgaaggacgcgaggtcgcgtcgccattatgttgtg

SEQ ID NO: 335969 - DNA, 653 bp, Homo sapiens
  misc_feature: GZ8MTXP01CHVXN.52.20.B09.1.454.CMB.2.raw
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (304)..(305): a, c, t, g, unknown or other
  misc_feature (304)..(305): n is a, c, g, or t
  modified_base (456)..(456): a, c, t, g, unknown or other
  misc_feature (456)..(456): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccactcccctgcactggaaccagcggtnactagttggtagttataactntgtctctgtaccaacaccaccaggaccaaacgccccaaatcatgtatttannatatcagtgactccggcccttcggtaggggtttacaatcgtcttcgtccgtcggctaccgaacgtcccgaaccaaccgccggtccctccctagaccctatcctcgtcgggcctaccgagggcccgagggacgaggtacttgtaattaattntcgactagtacttacgaaatttaaactaaaccaaaactaaacgtaacgtaaagggtttgggttacggttacgggacggggaacggtaaccaaggtcgtacggttacccgtccgttaacgggacaacggaccccgttaggcccgtaaccccgccccgttaacgtccctaccgttccttaacccggttcccctaacccg

SEQ ID NO: 335970 - DNA, 713 bp, Homo sapiens
  misc_feature: GZ8MTXP01A1O1K.52.20.B09.1.454.CMB.2.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccactcccctgcacgtggaaccnggcggtnactgttggtagttataactntgtctctgtaccaacaccaccagacaaacgccccaaatcatgatttangatatcagtgacgtcggtccctaggtaggggttacaatcgtacttctcgtcggactacgaacgtcccggaaaccaacgccggtccctacccgtacgtaccctacttcccgtacggttcgggacccttaccggaacggggaccggaacgggacggtacgggtacttagttaatttaacgtttattacggctaagtccctattaaagtaaactaaaccaaaaccgaaacttaaaacgtacggttacgggttacgggttaccgggaacggggtaaacggtaaccccaagggtaaccgttcggttaccccggtttaaccgaaggttacccgaaccggttaccccgaagggttccccgtaaccggtaccccccggttggttacccacgttacccgttcccgttcccccgtaaccccc

SEQ ID NO: 335971 - DNA, 333 bp, Homo sapiens
  misc_feature: GZ8MTXP01D6VRI.52.20.B09.1.454.CMB.2.raw
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (252)..(253): a, c, t, g, unknown or other
  misc_feature (252)..(253): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (329)..(333): a, c, t, g, unknown or other
  misc_feature (329)..(333): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattatgtgcgaaacttcctttgactggttattatcccctagtgaccactggggccagggaaccctggtcaccgtctcctcagcctccaccaaggcccatcgtctccccngcacctcncanncactcgngggcncagcggcctggctgctggtcaggctactccagtctctatctgagcggctggcaaggcgcatagnnnnn

SEQ ID NO: 335972 - DNA, 353 bp, Homo sapiens
  misc_feature: GZ8MTXP01EZ0GR.52.20.B09.1.454.CMB.2.raw
  modified_base (244)..(244): a, c, t, g, unknown or other
  misc_feature (244)..(244): n is a, c, g, or t
  modified_base (348)..(353): a, c, t, g, unknown or other
  misc_feature (348)..(353): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaaggcccatcggtctccccngcaccctcctccaagacgcacctcgtggggcacagcggccctgggctgcctggtcaaggactacttccagtactctatctgacgcggctggcaaggcgcatagnnnnnn

SEQ ID NO: 335973 - DNA, 338 bp, Homo sapiens
  misc_feature: GZ8MTXP01EH85V.52.20.B09.1.454.CMB.2.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (335)..(338): a, c, t, g, unknown or other
  misc_feature (335)..(338): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccacgtggggccagggaaccctggtcaccgtctcctcagcctccaccaaggccatcgtctccccngcacctcncagncactnggggcnagcggcctgggctgcctggtcaaggactacttccagtactctatctgagcggctggcaaggcgcatagnnnn

SEQ ID NO: 335974 - DNA, 364 bp, Homo sapiens
  misc_feature: GZ8MTXP01EA0WA.52.20.B09.1.454.CMB.2.raw
  modified_base (355)..(364): a, c, t, g, unknown or other
  misc_feature (355)..(364): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccacgtggggccagggaaccctggtcaccgtctcctcagcctccaccgaaggcccatcggtcttcccctggccaccctctccaagacgcacctcgtggggcacgacgcggcccgtgggctgcctggtacaaggactactccagtactctatctgagcgggctggcaaggctcatagnnnnnnnnnn

SEQ ID NO: 335975 - DNA, 294 bp, Homo sapiens
  misc_feature: GZ8MTXP01A7OTT.52.20.B09.1.454.CMB.2.raw
  modified_base (292)..(294): a, c, t, g, unknown or other
  misc_feature (292)..(294): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccactgggccagggaaccctggtcaccgtctcctcagcctccaccaagggcccatcggtcttcccctggcaccctctctatacgatcgctgagcgggctggcaaggcgcatagnnn

SEQ ID NO: 335976 - DNA, 370 bp, Homo sapiens
  misc_feature: GZ8MTXP01EGPN7.52.20.B09.1.454.CMB.2.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (353)..(370): a, c, t, g, unknown or other
  misc_feature (353)..(370): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattactcccctagtcgaccacgtggggccagggaaccctggtcaccgtctcctcagcctccaacgaagggcccatccggtccttcccctggccaccctctccaagncacctgtggggcacngccggccctgggctgcctggtacaaggctactcagtactctatctgacgcggctggcaaggctcatagnnnnnnnnnnnnnnnnnn

SEQ ID NO: 335977 - DNA, 295 bp, Homo sapiens
  misc_feature: GZ8MTXP02JWBYY.52.20.B09.1.454.CMB.2.raw
  modified_base (294)..(295): a, c, t, g, unknown or other
  misc_feature (294)..(295): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggcaccctcctctatacgatcgctgagcgggctggcaaggcgcatagnn

SEQ ID NO: 335978 - DNA, 593 bp, Homo sapiens
  misc_feature: GZ8MTXP02G7SQQ.52.20.B09.1.454.CMB.2.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (437)..(437): a, c, t, g, unknown or other
  misc_feature (437)..(437): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactntgtctcctggtaccaacaccaccaggcaaacgccccaaactcatgatttangatatcagtgatcggccctcgagggtttcaatcgcttctcctggctccaagtccggcaacnccggcctcctcgaccatctcgtcgggcctccgaggcccgaaggaccgagctgatttatattgcagtctacattaanaacaaaacaacaaactaagttcgggtattcggacggaagggacccaaagcgttacgacccgttaccgtacgggtaccaacgacccccgaaagggccctaacccggtcccccgttacgggttccaacccgttccgttccgtttacccccggtccccc

SEQ ID NO: 335979 - DNA, 589 bp, Homo sapiens
  misc_feature: GZ8MTXP02IRAYS.52.20.B09.1.454.CMB.2.raw
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcgtgacattggtgttataactatgtctcctggtaccaacaccacccaggcaaacgcccccaaatcatgatttangatatcagtgatcggccctgaggggtttcaatcgcttctctgctcagtccgcaacncggcctccngacccatctctgggctccgaggccgaggcgagctgattatatgcagctacattaataacaaaacaaacgaaactaagttggggtacgttcgggacggaacggggaaccaaaggccgtaggaacccgttacgtaacgggttaccaacggaccccctaaaggggccttaaccggccccccgttacgggttacccacccgtttccgttccgtttaccccctaaccccc

SEQ ID NO: 335980 - DNA, 347 bp, Homo sapiens
  misc_feature: GZ8MTXP02I35JR.52.20.B09.1.454.CMB.2.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (345)..(347): a, c, t, g, unknown or other
  misc_feature (345)..(347): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttcctttgactggttattatcccctagtgaccactggggccagggaaccctggtcaccgtctcctcagcctccacaagggcccatcggtcttcccctgcaccctcnccaagngcacctctggggcacagcggccctgggctgcctggtcaaggactacttccagtactctatctgagcgggctggcaaggcgcatagnnn

SEQ ID NO: 335981 - DNA, 544 bp, Homo sapiens
  misc_feature: GZ8MTXP02IT6E8.52.20.B09.1.454.CMB.2.raw
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactatgtctcctggtaccaacaccacccaggcaaacgcccccaaatcatgatttangatatcagtgatccggccctcgaggggtttcaatcgcttctcctggctccaagtccggacaacncggcctccctgaccatctctgggctccgaggccgaggacgaggctgattattatgcagctnattanaacaaacaacaaacaagttgggtgttacgggcggtaggggaccaaaggctagacccgtctaggtcacgacccaaggcctcgcccccgtggtccactccgtacgttccccaccc

SEQ ID NO: 335982 - DNA, 355 bp, Homo sapiens
  misc_feature: GZ8MTXP02F6ADM.52.20.B09.1.454.CMB.2.raw
  modified_base (351)..(355): a, c, t, g, unknown or other
  misc_feature (351)..(355): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccagtactctatctgagcgggctggcaaggcgcatagnnnnn

SEQ ID NO: 335983 - DNA, 644 bp, Homo sapiens
  misc_feature: GZ8MTXP02F200Y.52.20.B09.1.454.CMB.2.raw
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
tcagcgcagtacgacacgaccggtgctcgatttagtgtagtgtgaaggggagctctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtcgtgggggagcgtggtccagcctgggagtcctgagactcgcctgtaaaccgtcgatttacctcagtaactatgcaatgcacgtgggtccnccaggctccgaggcaaggggctggactggggtgcagctatatctatttgatggaaanctaaataaatactacgcaaggtacctaccggtaggaaacgggccgtaattaccgacctactttaccaacgtacgaacacgaccttaccggaactaaaccgaccggttactaaatccgttacgaccggtaaatacgaaaccgtaacgccccgtaggaacgaaccgtaggaacggaaccgtaccgggtaccttttcgtttttaccgtaggttacggtccggtacccgaagggaaacgtccggaaggttcgggaccgttacgggtaccccgaacgtaacgtcggtaacgtttcgg

SEQ ID NO: 335984 - DNA, 570 bp, Homo sapiens
  misc_feature: GZ8MTXP02IU0V9.52.20.B09.1.454.CMB.2.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
tcagcgcagtacgacacgaccggtgctcgatttagtgtagtgtgaaggggagctctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctgggtggagtctgggggagcgtggtccagcctggggacgtcccngagctcgctagtaaaccgtcgatttacctnagtaactntgcaatgcacgtgggtcccncaggcctcgaggcaaggggctggacgtggggtgcagctatntctatttgatggaancaaaataaactctacgcaagacctccgtaggaacggggcctatcactacttaccgagaganagtcctacgaataacgacgtctatctgacgatacgaacagcctagacgtaccgtaggacggtaaccgtacgggtccttttacgtttttaccgtggtcggtaccggaccgaagggaaacgcgtaaggtggcgtcggaccacgacttacgagtttcg

SEQ ID NO: 335985 - DNA, 545 bp, Homo sapiens
  misc_feature: GZ8MTXP02HU3IP.52.20.B09.1.454.CMB.2.raw
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (424)..(424): a, c, t, g, unknown or other
  misc_feature (424)..(424): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtgttataactatgtctcctggtaccaacaccactcaggcaaagccccccaaatcatagatttatgatatcagtgatcgcctcgagggttcaatcgcttcctctgctccaagtcccgganaccacggcctcccngtacccatctctggactccgaggccgaggacgaggctagtattatattgctacnctactaataactaaacaaacaaacaacgtaagttgggtacggtacggacggacggaactacgacgtacgaccgtacgtacgcacgaccgagccgtccgcccgtcgctacctcgttcctccc

SEQ ID NO: 335986 - DNA, 529 bp, Homo sapiens
  misc_feature: GZ8MTXP02J0T78.52.20.B09.1.454.CMB.2.raw
  modified_base (234)..(234): a, c, t, g, unknown or other
  misc_feature (234)..(234): n is a, c, g, or t
  modified_base (363)..(363): a, c, t, g, unknown or other
  misc_feature (363)..(363): n is a, c, g, or t
  modified_base (449)..(449): a, c, t, g, unknown or other
  misc_feature (449)..(449): n is a, c, g, or t
tcagcgcagtacgacacgaccggtgctcgatttagtgtagtgtgaagggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccatccccttgcactggaaccagcggtgacnttggtggttataactatgtctcctggtaccaacaccacccaggccaaagcccccaaatcatgatttatgatatcagtgatcggccctcaggggttttcaatcgcttctcctggctcaagtccggcaacncggcctcctgaccatctctgggctcaggccgaggacgaggctgattattattgcagcttacatatacaaacacaaactaatgggtntcggggcgaggggaccaaaggctagacccgtctagggtcacgcccaaggctcgcccctggccactctcgtcccctacccc

SEQ ID NO: 335987 - DNA, 553 bp, Homo sapiens
  misc_feature: GZ8MTXP02F3H2H.52.20.B09.1.454.CMB.2.raw
  modified_base (364)..(364): a, c, t, g, unknown or other
  misc_feature (364)..(364): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtgttataactatgtctctgtaccaacaccaccaggcaaacgccccaaactcatgatttatgatatacagtgactcggccctcgaggggtttcaatcgtcttctccgtgcctacaacgtccgacaacnccggcctccctgacccatctctcgggctccgaggccgaggacgagctgtattattatgctagctacatataacaaacaaacaaactaagttggtagtacggacggaaggaccaagctacgaccgtaccgtaaggcacgacccgaacggccgtccgccccctcggtaccacgtcctccgttccccgtccc

SEQ ID NO: 335988 - DNA, 631 bp, Homo sapiens
  misc_feature: GZ8MTXP02FHM99.52.20.B09.1.454.CMB.2.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
tcagcgcagtacgacacgaccggtgctcgatttagtgtagtgtgaaggggagctctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtcgtgggggaggcgtggtccagcctggggacgtcctgagactcgctagtaaccgtcgtatttacctnagtactangacatgcacgtcgggtccgccaggcctcgaggacgaaggggctggacgtggggtggcagctatatctattgataggaagactaaagtaaactacgtacgcaagtaccgttaccgaggaacgggtcctaagtttaccaacttacttaccaagagtaaccacgcctaccgaaactaaaccgacggttactaacgtctagtacgtaaagtacgaaacgacgtacccgtagaacggtaccgtagggaacgaccgtacggtacctttttcgtttttaaccgtggtaccgtccggaccgtaacgggtaaacgcgtaacggtcggcgtacgggcctaacgtacgtacgtacgtttacgg

SEQ ID NO: 335989 - DNA, 576 bp, Homo sapiens
  misc_feature: GZ8MTXP02FV43Y.52.20.B09.1.454.CMB.2.raw
  modified_base (300)..(301): a, c, t, g, unknown or other
  misc_feature (300)..(301): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccactcccctgccactggaaccagcggtgactattggtggttataactatgtctctgtaccaacaccaccaggcaaacgccccaaatcatgatttannatatcagtgatcggccctgtaggggtttcaatcgtcttctccgtcggcctaccgaacgtccggacaaccgccggtcccctccctacgacccattcctcgtcgggcctccgacggccgaggacgaggctagtatttatatgctagctacaataataaccaaaanaacaacgaagttgggtgtacgggnggaaagggacaaggctacggaccgtcgtaaggccacgaccaacggtcctccggcccccgtacggtccacttccgtccgttcccctccc

SEQ ID NO: 335990 - DNA, 631 bp, Homo sapiens
  misc_feature: GZ8MTXP02HERDD.52.20.B09.1.454.CMB.2.raw
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccactcccctgcactggaaccaggcggtnactagttggtagttataactatgtctcgtgtaccaacaccaccgaggaccaaaccgcccccaaactcatgtatttangtatatcagtgacgtccggaccctaggtacggggtttacaacgttcgtcttctccgtcgcctacgaacgtccgacacgccgcctcngaccntctcgtcggcctcgacggcgaggacgagctagtattatatgactagtctataactaacaaaccaaaactaaactaaacgtaggttcgggtacggttcgggacgggtaacgggaaccaaggtccgtacggtaccggtaccgtaacggtcccgaacggtacccgaacggtcccgtaacccggtcccccgtacggtaccctaccgtttcccgtacccgttaccccctaaccccg

SEQ ID NO: 335991 - DNA, 352 bp, Homo sapiens
  misc_feature: GZ8MTXP02HIF4N.52.20.B09.1.454.CMB.2.raw
  modified_base (347)..(352): a, c, t, g, unknown or other
  misc_feature (347)..(352): n is a, c, g, or t
tcagcgcagtacgacacgaccggtgctcgatttagtgtagtgtgaagggccggttcaccatctccagagacaattccaacagcacgctgtatttgcacatgaacagcctgagagccgaggacacggccatatattattgtgcgacacttccttttgactggttattatcccctagtgaccactggggccagggaaccctggtcaccgtctcctcagcctccaccaaggcccatcggtcttcccctgccaccctcctccaagcgcacctctggggcacagcggccctgggctgcctggtcaaggctacttccagtactctatctgagcgggctggcaaggcgcatagnnnnnn

SEQ ID NO: 335992 - DNA, 359 bp, Homo sapiens
  misc_feature: GZ8MTXP02F8BTI.52.20.B09.1.454.CMB.2.raw
  modified_base (352)..(359): a, c, t, g, unknown or other
  misc_feature (352)..(359): n is a, c, g, or t
tcagcgcagtacgacacgaccggtgctcgatttagtgtagtgtgaagggcctgttcaccatctccagagacaattccaacagcacgctgtatttgcacatgaacagcctgagagccgaggacacggccatatattattgtgcgaaacttccttttgactggttattatcccctagtgaccacgtggggccagggaaccctggtcaccgtctcctcagcctccaccaagggcccatcggtcttcccctggccaccctcctcaagagcacctcgtggggcacagccggccctgggctgcctggtcaaggactacttccagtactctatctgagcggctgcgaaggcgacatagnnnnnnnn

SEQ ID NO: 335993 - DNA, 615 bp, Homo sapiens
  misc_feature: GZ8MTXP02GMRL5.52.20.B09.1.454.CMB.2.raw
  modified_base (232)..(232): a, c, t, g, unknown or other
  misc_feature (232)..(232): n is a, c, g, or t
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
  modified_base (459)..(459): a, c, t, g, unknown or other
  misc_feature (459)..(459): n is a, c, g, or t
  modified_base (574)..(574): a, c, t, g, unknown or other
  misc_feature (574)..(574): n is a, c, g, or t
tcagcgcagtacgacacgaccggtgctcgatttagtgtagtgtgaagggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgccactggaaccagcggtnactattggtgttataactatgtctctgtaccaacaccaccaggacaaacgcccccaaatcatgtatttangatatcagtgactcggccctgtagggtttcaatcgcttcnccgtggctacgacgtccggacaacgccggtcctccccgtagaccctatccgtcgtcgggtaccctccgacggcccgaagggacgaggtctagtatttacgttatcgactagtcctanaattaactaaacaaaactaaacaaacgtaaggttacgggggttacgtacggggacggaacgggaaccaaaggtccgtacggtaccgtcgttaaaggccacggacccaacggtccnccgtacccccgtggtacccacgtcctccgtacccctacccc

SEQ ID NO: 335994 - DNA, 606 bp, Homo sapiens
  misc_feature: GZ8MTXP02FVPSW.52.20.B09.1.454.CMB.2.raw
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccactcccctgccactggaaccagcggtgaactagttggtaggttataactatgtctcctggtaccaacacccaccaggacaaacgcccccaaatcaatcgatttatgatatacagtgatccggccctcgtagggggtttacaagtcgtcttctccnggctacaagtccggacaacncggacctccctagacccatctcgcgggcctccgaacgggcccgaaggcgaacgggctgtattattacggttnacatctactaataactaaacaaaaaccaaactaaacgtaaggttcgggtacggttcggggaacgggaacggacgaacgtcgtacgtaccgtacgtacggacgaccgacccgagccctccgtccccgtcgtacctacgtcctacctacccctacc

SEQ ID NO: 335995 - DNA, 626 bp, Homo sapiens
  misc_feature: GZ8MTXP02I5W07.52.20.B09.1.454.CMB.2.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (396)..(396): a, c, t, g, unknown or other
  misc_feature (396)..(396): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacaggtcctgggcccagtctgccctgactcagcctgcctcgtgtctgggtctcctggacagtcgatcaccactcccctgccactggaaccagcggtnactattggtgttataactntcgtctcctggtaaccaacaccaccaggcaaacgcccccaaatcatgatttangtatatcagtgatccggccctacgtaggggtttcaatccgnttcctcgtcgcctaccaaggtcccgacaaccctcgggccctcccgtgaacccnttctcgtcgggcctcgacggccgaggacgaggctagtatttagttatcgcagactcaacgtataaaccaaaactaaaccaaactaggttcggtacgttacggggacggaacgggtaccaaggtacgtacggtaaacccgttcgtaaacggtccgaacgaccccgaaacggttccccgtcgtccccccgttggtacccctacgttaccccgtttccgtcccccgtttcccc

SEQ ID NO: 335996 - DNA, 614 bp, Homo sapiens
  misc_feature: GZ8MTXP02FXBGJ.52.20.B09.1.454.CMB.2.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (594)..(594): a, c, t, g, unknown or other
  misc_feature (594)..(594): n is a, c, g, or t
tcagcgcagtacgacacgaccggtgctcgatttagtgtagtgtgaagggggctgggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatccaccactcccctgcacgtggaaccaggcggtanactagttggtagttataactatgtctcctggtaaccacaccaccaggaccaaacgcccccaaatcagtgtatttangtatantagtgcgtccggccctaggtacgggtttacacgtcgtccttcgtcccgtcgtacctacgacggtcccgacctaccgccggtccctaccgtacgacctctccgtcgcggcctaccggacggcggagacgtgtactagttatttagtgtcgactacactaactaactaacaaaccaaaactacgtaaacgtaggttcgggtacggtacggacgggaacgacgacgtacgacgtaccgtacgacgcgaccgaccgtcgtccgcccgcccgtcgtccncgtccgtccctaccctaccg

SEQ ID NO: 335997 - DNA, 625 bp, Homo sapiens
  misc_feature: GZ8MTXP02HYNEW.52.20.B09.1.454.CMB.2.raw
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (389)..(389): a, c, t, g, unknown or other
  misc_feature (389)..(389): n is a, c, g, or t
tcagcgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccactcccctgccactggaaccagcggtnacattggtgttataactatgtctcctggtaccaacaccacccaggacaaacgcccccaaatcatgatttangatancagtgactccggccctcgtaggggtttcaatcgcttctcctgcctccaagtcccggacaacgccgcctcccagacccatcncgtggcctcgacggcgaggacgagctgtattattagtctacgagtctacctaaattaataaccaaaaaccaaacgtaaaacgttaaggtttaggggttcgggttaccggggacggggaacgggtaaaaccgtaaacggtccgtacggtacccgtaccggttacggtaccgaccgacccgaacggtacccgtccgcccccgttacggtccctaccgtccttccgtacccccgtcccc

SEQ ID NO: 335998 - DNA, 503 bp, Homo sapiens
  misc_feature: GZ8MTXP01D08J0.4.34.D01.1.454.CMB.2.raw
  modified_base (299)..(299): a, c, t, g, unknown or other
  misc_feature (299)..(299): n is a, c, g, or t
  modified_base (472)..(472): a, c, t, g, unknown or other
  misc_feature (472)..(472): n is a, c, g, or t
  modified_base (491)..(491): a, c, t, g, unknown or other
  misc_feature (491)..(491): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtactgcagaaacctggccaggctcccaggctcctcatctatggtncatccacagggccactggtatcccagccaggttcagtgccagtgggtctgggacagagttcactctcaccatcagcagcctgcagtctgaagtatttgtacgtttattacgtgtcagctagtatgataactggtctgtactcgtttggccgttaggggaccaagcgtaggagnttacgaaggcgaacttggnggctgctaaccg

SEQ ID NO: 335999 - DNA, 505 bp, Homo sapiens
  misc_feature: GZ8MTXP01A0X9H.4.34.D01.1.454.CMB.2.raw
  modified_base (300)..(300): a, c, t, g, unknown or other
  misc_feature (300)..(300): n is a, c, g, or t
  modified_base (476)..(476): a, c, t, g, unknown or other
  misc_feature (476)..(476): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaacctggccaggctcccaggctcctcatctatggtncatccaccgagggcccactggtactcccagccaggttcagtgccagtgggtctgggacagtagttcactctcaccatcagcagcctgcagtctagaagtatttgtcgtttattacgtgtcagcagtatgataactggtctgtactgtttggccgttaggggaccaagcgtggacgnttcgaaggcgaacgtggtggctgctaacc

SEQ ID NO: 336000 - DNA, 514 bp, Homo sapiens
  misc_feature: GZ8MTXP01D94U7.4.34.D01.1.454.CMB.2.raw
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (485)..(485): a, c, t, g, unknown or other
  misc_feature (485)..(485): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctnatctatggtncatccaccgagggccactgtactcccagccaggttcagtgccagtgggtctgggacagagttcactctcaccatcagcagcctgcagtctgaagtatttgtacgtttattacgtgtcagctagtatgtataacgtggtcttgtactcgttttcggccgttaggggaccttaaggcgtaggagnttcgaaggcgtaacgtgtggctgctaacc

SEQ ID NO: 336001 - DNA, 566 bp, Homo sapiens
  misc_feature: GZ8MTXP01C9P2D.4.34.D01.1.454.CMB.2.raw
  modified_base (439)..(439): a, c, t, g, unknown or other
  misc_feature (439)..(439): n is a, c, g, or t
  modified_base (552)..(552): a, c, t, g, unknown or other
  misc_feature (552)..(552): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgtagcagcaacttagcctggtacctgcagaacctggccaggctccagcctcctcatctagtggtcgcactcccacgacggggcccacgttggtacctcccgagtcccgtacggtttccaggtcgcccgtagggttcggggtctgggggaactagggtacgtttaccactcctacaccctatcagcagcctgctagtctagaagttntttggtacgttttattacgtgtacagtactagtatagtattaacgtggtcttacgtacgttacgtttcggccgaggggtaccagtcgtggagattcgaaggacgtaacgttgnggactcgctaaccg

SEQ ID NO: 336002 - DNA, 516 bp, Homo sapiens
  misc_feature: GZ8MTXP01BXREV.4.34.D01.1.454.CMB.2.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (474)..(474): a, c, t, g, unknown or other
  misc_feature (474)..(474): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgtagcagcaacttagcctggtacctgcagaaacctggccaggctcccaggcctcctcatctatggtncatcccaccgagggccactggtactcccagccaggttcagtgccagtgggctgggacagagttcactcncacatcagcagcctgccagtctagagttatttgtacgtttattacgtgtcagctagtatgataactggtctgtactgtttcggccgaggggaccgagcgtggagngttaccgaagggtccgaacgttggtaggctcggccgtaaccg

SEQ ID NO: 336003 - DNA, 564 bp, Homo sapiens
  misc_feature: GZ8MTXP01CNVXO.4.34.D01.1.454.CMB.2.raw
  modified_base (308)..(308): a, c, t, g, unknown or other
  misc_feature (308)..(308): n is a, c, g, or t
  modified_base (533)..(533): a, c, t, g, unknown or other
  misc_feature (533)..(533): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagacaacttagcctggtacctgacaagaaacctggaccaggcctcccaggcctcctcatctatggtcncactccaaccgagggcccacgtggtactcccagcctaaggttcagtcgccaggtcgggtctgggactagacgttcactctacaccatcagcagcctgaccgtagtcgtagaagttattttggtacggttttaattaacggttgttacaagtcgtaagtagtagtaattaaacgtggtaccttaggtactaacgtttggaccgttaggggaaccaggtcgtggagnacgaaggaccgaagttgggtgctcgctaacg

SEQ ID NO: 336004 - DNA, 561 bp, Homo sapiens
  misc_feature: GZ8MTXP01D5VI5.4.34.D01.1.454.CMB.2.raw
  modified_base (309)..(309): a, c, t, g, unknown or other
  misc_feature (309)..(309): n is a, c, g, or t
  modified_base (430)..(430): a, c, t, g, unknown or other
  misc_feature (430)..(430): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgacaagaaacctggccaggcctcccgaggcctcctcatctatggtncatcccaccgacgggccacgtggtactcccgagcccaggttccagtcgacccaggtcgggtctggggacaggtacgttcacttcacaccatcagcacgcctgacctagtactagtaagttntttacgtacggtttattacgtggttacaggtactaagtatgtaattaacgtggtcttacgtacctcgtttcggccgttaggggaccaagcgtaggagcgttcgaaggtacgaacgtgtcggctcgctaacc

SEQ ID NO: 336005 - DNA, 536 bp, Homo sapiens
  misc_feature: GZ8MTXP01A6ZKV.4.34.D01.1.454.CMB.2.raw
  modified_base (302)..(302): a, c, t, g, unknown or other
  misc_feature (302)..(302): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccagggacagagccaccctctcctgcagggccagtcagagtgttagcagcaacttagcctggtacctgacagaaacctggccaggcctcccaggcctcctcatctatggtnccactcccaccgacgggcccaacgtggtactcccagcctaggttcagtcgccaggtcgggtctggggactagacgttcacgtctacaccntacagcagcctgacngtcngaagtagtttgcgtttattacgtgtcagactagtatgattacgtgtcttagtacctcgtttggccgttaggggaccaggtcgtggagcgttacgaaggcgtaacgtggtcggctcgccgtaaccg

SEQ ID NO: 336006 - DNA, 509 bp, Homo sapiens
  misc_feature: GZ8MTXP01E252X.4.34.D01.1.454.CMB.2.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
  modified_base (475)..(475): a, c, t, g, unknown or other
  misc_feature (475)..(475): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaacctggccaggctcccaggctcctnatcatggtncatccacagggccactgtactcccagccaggttcagtgccagtgggtctgggacagagttcactctcaccatcagcagcctgacagtctagaagtntttgcgtttattacgtgtcagcagtntgataactggtcctagtactacgtttggccgttaggggaccaagcgtaggagttnttcgaaggacgtaacgtggtcggctggcctaacc

SEQ ID NO: 336007 - DNA, 596 bp, Homo sapiens
  misc_feature: GZ8MTXP01AYO5X.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgcagaaacctggccaggcctcccgaggcctcctcatctagtggtcgcactcccaccgacgggcccacgtggtactcccgagcctaggttcaggtcgccgaggtcgggtctggggactaggtacgttccacgtctacacatcagcagcctgctagtctagaagttgtttaggtacgtttattacggttgtacgtagtacgtagtatgtaaacttaacgtggtacgttacgttaacgttcggttttcgggaccggttaaggggtaacccgaaggtaccggtagggaacgttcgacggaagggcgtaacgtgggtcggaccgtcgaaccgtaaccg

SEQ ID NO: 336008 - DNA, 523 bp, Homo sapiens
  misc_feature: GZ8MTXP01BX35I.4.34.D01.1.454.CMB.2.raw
  modified_base (487)..(487): a, c, t, g, unknown or other
  misc_feature (487)..(487): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgtagcagcaacttagcctggtacctgcagaaacctggccaggctcccaggctcctcatctatggtgcatcccaccagggccacgtggtactcccagccaggttcagtgccaggtgggtctgggacagagttcactctcaccatcagcagcctgcagtctagtaagtattttgtacggtttattacgtgttcgagtctagtagtgtataacgtgtcgtagtactcgtttggccgttaggggaccaagcgtggagngttacgaaggcgaacgtggtggttcgtcgcgtaacc

SEQ ID NO: 336009 - DNA, 679 bp, Homo sapiens
  misc_feature: GZ8MTXP01BIXN1.4.34.D01.1.454.CMB.2.raw
  modified_base (281)..(281): a, c, t, g, unknown or other
  misc_feature (281)..(281): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggcccncgcgcctcactatctagtgtcactacacccgacggaccgacctacggtacgtaccctaccgacgtaccgtacgtacgtaggtccgtacggtgggttcgggttcggcgggacgtagttacgtacctaccttccaccaccttacacgaccggcgaccgtccgtacgtacgtacgttacgtaaggtaagttttacgtttcgggtttaacgttttaacttacgggtttcgtaacgtacgtagttaagttagtaagtaaacgtttacggtggttacgttaacgttaccgttttcgggttccgggaaccgggttaacgggaaaccgaacggttcgggtaaggaacgttcggacgggaacgggtaccgtaaggtttcgggacgttaccggtcgaacccgtaaccg

SEQ ID NO: 336010 - DNA, 524 bp, Homo sapiens
  misc_feature: GZ8MTXP01B0OU0.4.34.D01.1.454.CMB.2.raw
  modified_base (290)..(290): a, c, t, g, unknown or other
  misc_feature (290)..(290): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaacctggccaggctcccaggcctcctnatctatggtgcatccaccgagggccactggtactcccagccaggttcagtgccagtgggtctggggacagagttcactctcacatcagcagcctgctagtctgaagtatttgtcgtttattacgtgtacgagactagtatgtataacgtggtcttagtacctgtttcggccgttaggggaccaagtcgtgggagcgttacgaacgggcgtaacgtggtcggctcggcctaaccg

SEQ ID NO: 336011 - DNA, 547 bp, Homo sapiens
  misc_feature: GZ8MTXP01BM2C2.4.34.D01.1.454.CMB.2.raw
  modified_base (509)..(509): a, c, t, g, unknown or other
  misc_feature (509)..(509): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagcccaccctctcctgcagggccagtcagagtgttagcagcaacttagcctggtacctgcagaaacctggccaggcctcccgaggcctcctcatctatggtgcatcccaccgagggccacgtggtactccccgagcctaggttcagtgcccgtaggtcggggtctggggacaggtacgttcactcgtacaccatcagcagcctgacagtcgtagaagtatttgtacgtttattacgtgtctagctaagtatagtataacgtggtctagttactacgtttggaccgaggggaccaggcgtaggagngttacgaagggtcgtaacgtggtggcgtcgcgtaaccg

SEQ ID NO: 336012 - DNA, 561 bp, Homo sapiens
  misc_feature: GZ8MTXP01AE4A2.4.34.D01.1.454.CMB.2.raw
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtncatcccacgagggccacgtggtactcccagccctaggttccagtcgccgaggtggggtctggggacaggagttcactntacaccatcagcacgcctgctagtctagaagttgtttgtacggttttattacgttgtcgagtactagtatgtaagtaacgtggtcttacgtacgtcgttttggcccggttaagggggtacccaaggtcgtagggttagacgttacgaagggacgtaacgtggtcggctcggttcgtaaccg

SEQ ID NO: 336013 - DNA, 508 bp, Homo sapiens
  misc_feature: GZ8MTXP01E0SY7.4.34.D01.1.454.CMB.2.raw
  modified_base (216)..(216): a, c, t, g, unknown or other
  misc_feature (216)..(216): n is a, c, g, or t
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
  modified_base (480)..(480): a, c, t, g, unknown or other
  misc_feature (480)..(480): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagcccaccctcncctgcagggccagtcagagtgtagcagcaacttagcctggtacctgacagaaacctggccaggctcccaggcctccnatctatggtgcatccaccaggggccacgtggtactcccgagcctaggttcagtgccaggtgggtctggggacngagttcactctcaccatcagcagcctgcagtcagatatttgtaggtttattacgtgtcagcagtatgataacgtgtctagtactagtttggccgttagggaccaagcgtggagnttcgaaggcgaacgtgtggctgctaacc

SEQ ID NO: 336014 - DNA, 608 bp, Homo sapiens
  misc_feature: GZ8MTXP01EBERJ.4.34.D01.1.454.CMB.2.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagcaacttagcctggtacctgacagaaacctggccaggcctcccgaggcctcctnatctatggtncactccacgacgggccacgtggtactcccgagcctaggttccagtcgcccgtaggtcgggtctggggacaggtacgttccacctctacaccctatcaacgcacgtccctagacctagttctaggtaaagttgttttggtacggttttaattacgttggtaccagtctaagttataggtaattaaaccgtggtaccttagtaaccttcgtttaacgggacccgttaagggggaacccaaaggtccgtaagggacgttcttaccggaagggacgtaacgtgggtacggctcggaaccctaaccg

SEQ ID NO: 336015 - DNA, 534 bp, Homo sapiens
  misc_feature: GZ8MTXP01D49JO.4.34.D01.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
  modified_base (429)..(429): a, c, t, g, unknown or other
  misc_feature (429)..(429): n is a, c, g, or t
  modified_base (491)..(491): a, c, t, g, unknown or other
  misc_feature (491)..(491): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgacagaaacctggccaggctcccaggcctcctnatctatggtncatccacagggccactggtactcccagccaggttcagtcgccaggtgggtctggggacagacgttcactcncaccatcagcagcctgcagtctagaagtatttgacgtttatacgtgtcagcagtntgtataacgtggcttagtactgtttcgggaccgttagggggaccaaaggccgttagggaagngttaccgaagggaccgtaacgttggtgggctcggccgtaaccg

SEQ ID NO: 336016 - DNA, 598 bp, Homo sapiens
  misc_feature: GZ8MTXP01EKXP7.4.34.D01.1.454.CMB.2.raw
  modified_base (310)..(310): a, c, t, g, unknown or other
  misc_feature (310)..(310): n is a, c, g, or t
tcagagcactgtagcacgaccggtgctcgatttagatcgtctgtgttgggtttgggggaggaactgctcagttaggaaccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgacaagaaacctggcccaggcctcccgaggcctcctcatctatggtncatcccacgagggccacgtggtactcccgagcctaggttcagtcgccgtaggtcgggtctgggacagtacgttcactctacaccatcagcacgtcctagactagttctaggtaagttagttttggtacggttttaattacggttgtactagtataagtatagtaacttaaacgtggtacttagtacgttacgtttcgggaccgaagggggtaccttaaaggtccgtaagggaagttacgttacggtaaggggaccgtaacgtttgggcggttacttcggccgtaaccg

SEQ ID NO: 336017 - DNA, 514 bp, Homo sapiens
  misc_feature: GZ8MTXP01C40AQ.4.34.D01.1.454.CMB.2.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagagcactgtagcacgaccggtgctcgatttagatcgtctgtgttgggtttggggaggaactgctcagttaggacccagacggaaccatggaagccccagcgcagcttcctcttcctcctgctactctggctcccagaaaccactggagaaatagtgatgacgcagtctccaggcaccctgtctgtgtctccgaggggacagagccaccctctcctgcagggccagtcagagtgttagcagcaacttagcctggtacctgcaagaaacctggccaggctcccaggcctctcatctatggtncatccacagggccactggancccagccaggttcagtgccaggtgggtctgggacagtgttcactctcaccatcagcagcctgcagtctagaagtatttgacgtttattacgtgttcagtcagtatgataactggtctgtactcgtttggcccgaggggaccaaaggtctagggagttagttcgaaggacgaacgtggtcggctgcgtaacc

SEQ ID NO: 336018 - DNA, 530 bp, Homo sapiens
  misc_feature: GZ8MTXP01DABI9.4.34.D01.1.454.CMB.2.raw
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctccaggcctcctcatctatggtncatcccaccgagggccacgtggtactcccagcctaggttcagtgccaggtgggtctgggacaggtagttcactctacaccatcagcagcctgctagtctagtaagtatttgtacggtttattacgtgtcagtctagtatgataacgtggtctgtactcgtttcggccgagggggtaccaaggtcgtggagttagttcgaagggacgtaacgtggtcggctcgcgtaacc

SEQ ID NO: 336019 - DNA, 503 bp, Homo sapiens
  misc_feature: GZ8MTXP01AOZ21.4.34.D01.1.454.CMB.2.raw
  modified_base (301)..(301): a, c, t, g, unknown or other
  misc_feature (301)..(301): n is a, c, g, or t
  modified_base (472)..(472): a, c, t, g, unknown or other
  misc_feature (472)..(472): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccagggccactggtactcccagccaggttcagtgccaggtgggtctgggacagagttcactctcaccatcagcagcctgcagtctgaagtatttgcggtttattacgtgtctagcagtatgataactggtctgtactatttggccaggggaccaaggcgtggagnttcgaaggcgaacgttggtcggctcgcaacg

SEQ ID NO: 336020 - DNA, 614 bp, Homo sapiens
  misc_feature: GZ8MTXP01CPXZK.4.34.D01.1.454.CMB.2.raw
  modified_base (313)..(313): a, c, t, g, unknown or other
  misc_feature (313)..(313): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgttagcagctaacttagcctggtacctgacaagaaacctggaccaggcctcccgaggcctcctcatctatggtcncactcccaccgacgggcccacgtggtactcccgagccgtaggttcaggtcgcccgtaggtcggggtctggggactagggtacgttccacctctacaccatcgacgtcagccctggactagtctaggtaagttagttttcggtacggttttaatttacggtcgttacgtagtactaagttatagtattaaaccgtggtcttagtaccgttcgtttcggaccggaggggtaaccaggtcggtaggacgttacgttacggtaacgggacgtaacgttggtacggttcgtaacggccgtaacccg

SEQ ID NO: 336021 - DNA, 549 bp, Homo sapiens
  misc_feature: GZ8MTXP01D3R5R.4.34.D01.1.454.CMB.2.raw
  modified_base (296)..(296): a, c, t, g, unknown or other
  misc_feature (296)..(296): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccacctctcctgcagggccagtcagagtgttagcagcaacttagcctggtacctgcagaaacctggccaggctcccagctctcatctatgtncatccaccagggccactggtactcccagcctacggttcagtcgccaggtgggtctggggacagtagttcacgtctacaccatcagcagcctgacagtctagaattatttgtacgtttattagtcgtctagactagtatagtataacgtggtctacgttactacgttttcggcccggttaagggggtacccaaggtcgttaggaagttgttaccgaagggacgaacgttgggcggttccttcggccgtaacccg

SEQ ID NO: 336022 - DNA, 620 bp, Homo sapiens
  misc_feature: GZ8MTXP01B9ELB.4.34.D01.1.454.CMB.2.raw
  modified_base (314)..(314): a, c, t, g, unknown or other
  misc_feature (314)..(314): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcgagggccagtcagagtgtagcagcaacttagcctggtacctgacaacgaaacctggacccaggcctcccgaggcctcctcatctagtggncactcccacgacgggccctacgtggtacctcccgagcccgtaaggttccaggtcgacccgtagggtcggggtcctggggaacctaagggtacgttccaacttcctacaaccctatacgagcacgccttagactagtctaggtaagttagttttgtacgttttaatacggtgttacagtctaagttatagtaattaaccgtggtcttacgttacttcggtttaacggaccgttagggggtaaccaggtcgtagggattcgttacggaacgggtacgtaacgttgggtcggacctcggaacctaaccg

SEQ ID NO: 336023 - DNA, 657 bp, Homo sapiens
  misc_feature: GZ8MTXP01A1DDR.4.34.D01.1.454.CMB.2.raw
  modified_base (299)..(299): a, c, t, g, unknown or other
  misc_feature (299)..(299): n is a, c, g, or t
  modified_base (457)..(457): a, c, t, g, unknown or other
  misc_feature (457)..(457): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagccgtggtacctgacagaaacctggccaggcctcccgaggcctcctnatctagtggtcgcactcccacgacgggcccacgtggtactcccgagcctaggttcaggtcgccgtagggtcggggtcgtgggggaactagggtacgttcctaactcctacacccactcgaacgccacggcccttgacctagttactaggttaaagttntttttaggttagtttttacgttaacggttggtacgtagacgttaagtacgttagaactttaacgtcggtacctttacgttacgttaaccggttttcgggaaccggttaacgggggaaacccttagggccgtagggaaggttcttacgggaacggtacccggtaagttcgggtcgggttacctccggttaaccgtaacccg

SEQ ID NO: 336024 - DNA, 577 bp, Homo sapiens
  misc_feature: GZ8MTXP01D2S6A.4.34.D01.1.454.CMB.2.raw
  modified_base (298)..(298): a, c, t, g, unknown or other
  misc_feature (298)..(298): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgtagcagctaacttagcctggtacctgacagaaacctggccaggcctcccgaggcctctnatctagtgtgcatcccacgacgggccacgtgtactcccgagcccgtaaggttcagtcgcccgtaggtcgggtctggggactaggtacgttccacttcacaaccatcagcacgcctgacctagtactagaagttagtttgtacgtttacttacggtgtacagtactagtatgtaataacgtgtactagtaaccgtcgtttcggaccgttaggggacccttaaggtccgtagggaagttcacggaaggaccgtaacgtgggtcgggcttaacggctaaccg

SEQ ID NO: 336025 - DNA, 554 bp, Homo sapiens
  misc_feature: GZ8MTXP01BHFYL.4.34.D01.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
  modified_base (512)..(512): a, c, t, g, unknown or other
  misc_feature (512)..(512): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagcccaccctctcctgcagggccagtcagagtgttagcagcaacttagcctggtacctgcagaaacctggccaggctcccgaggctcctnatctatggtncatccacagggccagtggtactcccagcctaggttcagtgccaggtcgggtctggggacaggagttcactctcaccatcagcagctgacagtctagaatatttgtacggtttaattcggtgttcagtactagttangtattaaacgtggtcttaggttactaccgtttaagggcccgttaagggggacccttaaaggcgttagggaagngttccgaagggcgtaacgttgggcgggcttcggccgtaaccg

SEQ ID NO: 336026 - DNA, 533 bp, Homo sapiens
  misc_feature: GZ8MTXP01AXESQ.4.34.D01.1.454.CMB.2.raw
  modified_base (303)..(303): a, c, t, g, unknown or other
  misc_feature (303)..(303): n is a, c, g, or t
  modified_base (497)..(497): a, c, t, g, unknown or other
  misc_feature (497)..(497): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagcccaccctctcctgcagggccagtcagagtgttagcagcaacttagcctggtacctgcagaacctggccaggcctcccaggcctcctcatctatggtncatccaccgagggcccacgtggtactcccagccaggttcaggtcgccctaggtcgggtctggggacagggtacgttcactctcaccatcagcagcctgacagtctagtaagtatttgtacggtttattacgtgtcagactagtatgtataacgtggtctgtactcgtttggccgaggggaccaaggcgtggagngttcgaagggcgaacgtggtggttactgccgtaacc

SEQ ID NO: 336027 - DNA, 573 bp, Homo sapiens
  misc_feature: GZ8MTXP01D0OAD.4.34.D01.1.454.CMB.2.raw
  modified_base (538)..(538): a, c, t, g, unknown or other
  misc_feature (538)..(538): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagacaacttagcctggtacctgacaagaaacctggccaggcctcccgaggcctcctcatctatggtcgcactccaccgagggccacgtggtactcccagcctaggttcagtcgccgtaggtcgggtctggggacaggtacgttccacgtctacaccatcacgcacgcctgactagtctagtaagttagtttgtacgtttaattcggtgtctagtactagtatgtaattaacgtggtacttagtacgttcgtttaacgggaccgttagggggaaccttaaggtcgtagggacgttnttacggaaggtacgtaacgtggtggctgcctaacg

SEQ ID NO: 336028 - DNA, 507 bp, Homo sapiens
  misc_feature: GZ8MTXP01AXTW5.4.34.D01.1.454.CMB.2.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (396)..(396): a, c, t, g, unknown or other
  misc_feature (396)..(396): n is a, c, g, or t
  modified_base (494)..(494): a, c, t, g, unknown or other
  misc_feature (494)..(494): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccacctctcctgcagggccagtcagagtgttagcagcaacttagcctggtacctgcagaacctggccaggctccaggctcnatctatggtncatccaccagggccactggtatcccagccaggttcagtgcctaggtgggtctggggacaggagttcactctcaccatcagcagcctgacagtctgaagtntttgtcgtttattacgtgtcagcgtatagtgataacgtgtctagtactcgtttggccgagggggtaccaagcgtggagcttcgaaggcgtaacgtggnggactgcgtaacc

SEQ ID NO: 336029 - DNA, 618 bp, Homo sapiens
  misc_feature: GZ8MTXP01CCLHX.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagcaacttagcctggtacctgacagaaacctggccaggcctcccgaggcctcctcatctagtggtcgcactccaccgacgggccacgtggtactcccgagtccgtacggttccaggtcgacccgtaggtcgggtccgtggggactaagggtacgttccacgttctacaaccatcagcacgcctgaccagttctagtaagttagttttcgtacggttttaacttacgtgttaccgagtactaagttaagtagtaaacttaacgtgggttacttacggttaaccttacgttttcgggaccgttaacgggggtaaccacggtcggtaggacgagttaccgtaagggaccgtaacgttggtacggcgttcggccgtaaccg

SEQ ID NO: 336030 - DNA, 521 bp, Homo sapiens
  misc_feature: GZ8MTXP01EF9ZN.4.34.D01.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (412)..(412): a, c, t, g, unknown or other
  misc_feature (412)..(412): n is a, c, g, or t
  modified_base (488)..(488): a, c, t, g, unknown or other
  misc_feature (488)..(488): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccacactctcctgcagggccagtcagagtgttagcagcaacttagcctggtacctgcagaaacctggccaggctcccaggctcctnatctatggtncatccaccgagggccagtggtactcccagcccccagggttcagtgccctaaggtgggtctggggacaggtagttccacttctcaccatcagcagcctgcagtctagaagtnttttgcggtttattactgtcagcagtatgatactgctgtactaacgtttggccgtaggggttaccaagcgttaggngttatcgaggaaccgtatggttggccttgaacc

SEQ ID NO: 336031 - DNA, 565 bp, Homo sapiens
  misc_feature: GZ8MTXP01DEOUM.4.34.D01.1.454.CMB.2.raw
  modified_base (307)..(307): a, c, t, g, unknown or other
  misc_feature (307)..(307): n is a, c, g, or t
  modified_base (527)..(527): a, c, t, g, unknown or other
  misc_feature (527)..(527): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagcccaccctctcctgcagggccagtcagagtgtagcagctaacttagcctggtacctgacaagaaacctggccaggcctcccaggcctctcatctatggtncatcccacgacgggcccacgtcgtactcccgagtccgtaggttcagtcgccgaggtcgggtctggggacaggtacgttcacctcgtcaccatcagcagcctgactagtctagtaagtagtttgtacgtttattacgtgtctagtctaagtagtgtaactaacgtcgtcgtacgttactacggttttcgggacgacgggggtaccaaggtcgtagggacgngttacgaagggacgtaacgtggtaggctcgccgtaacg

SEQ ID NO: 336032 - DNA, 611 bp, Homo sapiens
  misc_feature: GZ8MTXP01B088O.4.34.D01.1.454.CMB.2.raw
  modified_base (307)..(307): a, c, t, g, unknown or other
  misc_feature (307)..(307): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgacagaaacctggccaggctcccgaggcctcctcatctatggtncactccaccgagggccagtggactcccagcctaggttcagtcgcctaggtcgggtctggggacctaggtacgttcaccttcctacaacccatcagtccacgtcctgacctaggttacctaggtaaagttacgtttttaggttacggtttttaacttacggttggttaccagggtactaagttataggtaattaaaccgtggtactaggttacctggtttcgggaccgttaagggggaccttaggtacgtagggacgttagttccgaagggtacgaacgttggacgggttctcggaacctaaccg

SEQ ID NO: 336033 - DNA, 557 bp, Homo sapiens
  misc_feature: GZ8MTXP01BKBY1.4.34.D01.1.454.CMB.2.raw
  modified_base (304)..(304): a, c, t, g, unknown or other
  misc_feature (304)..(304): n is a, c, g, or t
  modified_base (425)..(425): a, c, t, g, unknown or other
  misc_feature (425)..(425): n is a, c, g, or t
  modified_base (543)..(543): a, c, t, g, unknown or other
  misc_feature (543)..(543): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagccaccctctcctgcagggccagtcagagtgttagcagcaacttagcctggtacctgcagaaacctggccaggctcccgaggcctcctcatctatggtncactccacgacgggccacgtggtactccagccgaggttcagtcgcctaggtgggtcctggggactaggtacgttccacgtctacacccgatcacggcacggcctgaccagtctagaagttntttgtacggtttatcggtgtcgtagactaggtatgtaataacgtgtacttcgtacgttcgtttgggaccgttaggggacccaaggtcgtaggggattagttcgaagggcaagttcggnggctcggctaaccg

SEQ ID NO: 336034 - DNA, 568 bp, Homo sapiens
  misc_feature: GZ8MTXP01D4UKK.4.34.D01.1.454.CMB.2.raw
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (465)..(465): a, c, t, g, unknown or other
  misc_feature (465)..(465): n is a, c, g, or t
  modified_base (524)..(524): a, c, t, g, unknown or other
  misc_feature (524)..(524): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgagggacagacgccaccctctcctgcagggccagtcagtagtgttagcagctaacttagcctggtacctgacaagaaacctggccaggcctcccgaggcctcctnatctatggtcncactcccgaccgagggccctagttcggtactcccgagcccgtaggttcagtcgccgtaggtcgggtactggggactaggtacgtttccactctacaccatcagcacgcctgactagtctagagttagtttgtcgtttatacggtgtcagctagtntagtatacgtgtcttagtacttcgttggaccgaggggaccttaggcgttagggacgttnttacgggaacgggtcgtaacgttgggacgttcgtcgcctaaccg

SEQ ID NO: 336035 - DNA, 586 bp, Homo sapiens
  misc_feature: GZ8MTXP01BS4IJ.4.34.D01.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagcccaccctctcctgcagggccagtcagagtgttagcagcaaacttagcctggtacctgacaagaaaccctggcccaggcctcccgaggcctcctnatctatggtgcatccacgngggccagtggactccagcctaggttcagtgccaggtgggtctggggacagtagttcacttcncacatcagcagccngactagtctagtaagtagtttgtacgttttaattcgttgtcctagactagttagtagtaagttaaccgtggtcccgttagttaccgttacgttttaacgggacccgttaagggggtaacccgttaggaccgttggaacggttgttacggaacgggtacgtaacgttcgggtggttcttcggcgtaacccg

SEQ ID NO: 336036 - DNA, 593 bp, Homo sapiens
  misc_feature: GZ8MTXP01E19WK.4.34.D01.1.454.CMB.2.raw
  modified_base (309)..(309): a, c, t, g, unknown or other
  misc_feature (309)..(309): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagctaacttggcctggtacctgacaagaaacctggccaggcctcccgaggcctcctcatctagtggtncactccccgaccgaggggccctacgtcggtaactccccgaggcccgtagggttcaggtcgacccgtagggtcgggtcgtggggacaggtactcactctacacatacacgcacgcctgacgtagtacgtaggtaaagttcgttttaggtacgttttacttacgggttgtacgtacgtactaaggtatagtaagttacgtggtctagtacgtacgttcggaacggttacgggacgagcgtaggagttcgttacggaacggcgtaagtggtcggctcgccgtaaccg

SEQ ID NO: 336037 - DNA, 610 bp, Homo sapiens
  misc_feature: GZ8MTXP01B9SPO.4.34.D01.1.454.CMB.2.raw
  modified_base (308)..(308): a, c, t, g, unknown or other
  misc_feature (308)..(308): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagcaacttagcctggtacctgacaagaaacctggccaggcctcccgaggcctcctcatctagtggtnaccatcccaccgacgggccacgttggtactcccgagcccgtaggttcaggtcgcccgtaggtcgggtctggggactaggtacgttccaacttcctacaacctatacgagcacgcctgactagtctagtaagttgtttagttagttttattacgttgtacgtagtacgtagttagtagtaattaacgtggtcttacgttacgttacgttttcgggaccggttacggggaacccgttaaggtacggttggaacggttcgttacggaacgggtacgtaacgtggtcgggcttcggaactaacccg

SEQ ID NO: 336038 - DNA, 488 bp, Homo sapiens
  misc_feature: GZ8MTXP01DQ3YA.4.34.D01.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctctcatctatggtncatccacagggccactggtancccagccaggttcagtgccagtgggtctggggacagagttcactctcaccatcgancagctgcatctgaagtatttgtcgtttattacgtgtnaganagtatagataaatgtntagtactactttgtcgagggacgaagcgtgagnanaagagaacgngtgctgcnc

SEQ ID NO: 336039 - DNA, 496 bp, Homo sapiens
  misc_feature: GZ8MTXP01C4WT3.4.34.D01.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (417)..(417): a, c, t, g, unknown or other
  misc_feature (417)..(417): n is a, c, g, or t
  modified_base (487)..(487): a, c, t, g, unknown or other
  misc_feature (487)..(487): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgacagaaacctggccaggctccaggctctnatctatggtncatccacagggccatggtactcccagccaggttcagtgccagtgggctgggacagagttcactctcacatcagcagctgcagtctgaagtatttgcgtttattactgtcaagcagtntgtataaactggtctagtactgttttggccagggggaccaaagcgtaggagcttgaagggcgaattgggngcgtcgctc

SEQ ID NO: 336040 - DNA, 593 bp, Homo sapiens
  misc_feature: GZ8MTXP01A3DPM.4.34.D01.1.454.CMB.2.raw
  modified_base (308)..(308): a, c, t, g, unknown or other
  misc_feature (308)..(308): n is a, c, g, or t
  modified_base (553)..(553): a, c, t, g, unknown or other
  misc_feature (553)..(553): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagcaacttagcctggtacctgacaagaaacctggcccaggcctcccaggcctcctcatctagtggtncactcccaccgacgggcccacgtggtactcccgagccgtaggttcagtcgccgaggtcgggtcgtggggactagggtacgttccacgttcctcaccatcgagtcacgtcctgacctagttcgtagtaaacgttgttttcggtacgtttttaacttacggttcggttactagtacgtaagttagtagtaattaacggtgtcttagttacgtacgtttcggacgttacgggaccaggtacgtggagnttacggaacggacgtaacgtggtcggactcgaaccgtaac

SEQ ID NO: 336041 - DNA, 635 bp, Homo sapiens
  misc_feature: GZ8MTXP01AFFJY.4.34.D01.1.454.CMB.2.raw
  modified_base (310)..(310): a, c, t, g, unknown or other
  misc_feature (310)..(310): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgtagcagcaacttagcctggtacctgacaagaaacctggccaggcctcccgagcctcctcatctagtggtcncactcccgaccgagggccctacgtggtactcccgagccgtacggttcaggtcgaccgtagggttcggggtacgtggggaacacgggttacgtttacccaccttcaccacctactcgacgcacggtcctgaccgtagttcgtaggtaacgtttacgttttcggttacggttttattacggttgtacgtagtacgtaagtatagtaacttaacgtcggttctagttaccgttcgtttcgggaaccggttaaggggtaaccgaggtcgtagggacgttcggttacggaacgggtacgtaacgtggtcggactcggttaaccgtaaccg

SEQ ID NO: 336042 - DNA, 597 bp, Homo sapiens
  misc_feature: GZ8MTXP01BYZPB.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgttagcagctaacttagcctggtacctgacaagaaacctggaccaggcctcccgaggcctaccgtcatctagtggtcgacactcccgaccgacggggccctacgttcggtacctcccgagcccgtaggttcagtcgcccgtagggtcgggtacgtggggaactaggtacgttccaactctacaccatcagcagcctgactagtactagtaagttagtttcgtacgttttacttacggtgtacgtagtacgtagtagtagtaagtaacgtggtcttagttacgttcgtttcgggacgttaggggaccaggtcgtaggacgcgttcgaagggacgtaacgtggtcggcgtcgccgtaaccg

SEQ ID NO: 336043 - DNA, 601 bp, Homo sapiens
  misc_feature: GZ8MTXP01C118Q.4.34.D01.1.454.CMB.2.raw
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatacgccttcctcccgtcccccttgcagtaacaccaagtacagaatattaacctgttacccatcgactacgcctttcggcctcgccttagggcactcaccctgccccgatacgtgacaggaaccccttggtctcggcgagcgggtctttcgacctntttactccgttactatgtcagcattcgntacttcnactacctccancatcgcncacacacactacctacacacgactacaacgaccgaccctacccctaacccaaaccaaccacaactacgacgtcgtctcgccgcgaacgtcgttcgtcgttcgtacgttacgtttaccgttcccgttacctaacctaccttcccgtacctacttactaacgttaacgtaacg

SEQ ID NO: 336044 - DNA, 571 bp, Homo sapiens
  misc_feature: GZ8MTXP01C971Z.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaactggccaggctcccaggctctcatctatggtcgcatccaccgagggccacgtggtactcccagccctaaggttcagtcgcccgtaggtcgggtctggggacaggacgttcactctcaccatcagcagcctgcagtctagaagtatttgtacggtttattacgtgttacgagtcgtagtatagattaaacgtggtacttacggtacttaacgttttcgggaccgttaagggggtaacccaaggtccgttagggaacgttgttacgaagggtacgtaaacgttcggtgggccttcggccgtaaccg

SEQ ID NO: 336045 - DNA, 722 bp, Homo sapiens
  misc_feature: GZ8MTXP01DRU57.4.34.D01.1.454.CMB.2.raw
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
tcagagcactgtagcacgaccggtgctcgatttagatcgtctgtgttgggtttggggaggactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtaccngacaagaaacctggccaggcctcccaggcctcctnatctagtggtcgccatccccaccgacgggcccaacgttggtactccccgaggccctaggttaccaggtcgccgtagggttcggggtcgtgggggaacctaagggtactttaccaccctttcaccctaaaccctacgtacccgaacggccgacgtccccgttacggacccgttaaggttaccgttaagggtaaacgtttaagtttttcgggttaaccgggtttttaaactttaccggttaggtttaccgtaacggtaccgttaaagggttaacttaggttaaacgtttaaaccggtggttccgtttacgtttaaccgttacggtttttaacgggaacccggttaagggggaaccccgttaaggtaccgttgggaaagttcgttacggaagggtaccgtaacgttggcgttcgtcgttaaccgtaacc

SEQ ID NO: 336046 - DNA, 744 bp, Homo sapiens
  misc_feature: GZ8MTXP01A810D.4.34.D01.1.454.CMB.2.raw
  modified_base (362)..(362): a, c, t, g, unknown or other
  misc_feature (362)..(362): n is a, c, g, or t
tcagagcactgtagcacgaccggtgctcgatttagatcgtctgtgttgggtttgggggaggaactgtctcagttaggacccagacggaaccatggaagccccagcgcagcttctcttcctcctgctactctggctccagaaaccactggaagaaatagtgatgacgcagtctccaggcacctgtctgtgtctccgaggggacagacgccaccctctcctgcgagggccagtcagagtgtagcagactaacttagccgtggtacctgacaagaacctggccaggcctccgaggcctcctacattctagtgggtcacctactccccgaaccggacggggtacccctacggttacggttaacccnccccggaaggtaccccgtaagggttccaacgggtcgacccggtaggttcggggtacctgggggacctaagggtaccgtttaccacgtcctactaacccactacgacgccgacgtcccgtagtacgtacgttacgttaggtaaacgtttacgttttacggttacgggttttaaactttacgggttacgtacgttaacggtacgttaaaggtttaacttacggttaaacgtttaaaccggttcggttaccgtttaaccggttaaccgtttaaccgggttttaacgggaacccggttaaacgggggtaacccttaaagggtccgtaagggacgttacgttacggaacggtacgtaacgtcggtcgttacgttcggccgttaaccg

SEQ ID NO: 336047 - DNA, 592 bp, Homo sapiens
  misc_feature: GZ8MTXP01BOJ07.4.34.D01.1.454.CMB.2.raw
  modified_base (234)..(234): a, c, t, g, unknown or other
  misc_feature (234)..(234): n is a, c, g, or t
  modified_base (438)..(438): a, c, t, g, unknown or other
  misc_feature (438)..(438): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagngtgttagcagcaacttagcctggtacctgacagaaacctggccaggcctccgaggcctcctcatctagtggtcgcactcccacgacgggccctacgtcggtactcccgagtccgtaggttcaggtcgccgtaggttcgggtactggggaacaggtacgtttccacttcactaccatcagcagtcctagcagttcagtaacgttntttggtacgtttattactgtacgagtacgtagtagtagtaacgtacgtgggtcttagttacgttaccgtttgggaccggttaagggggtacaacgggtctagggagttacgttcggtaaggacgtaacgttgggcggacgtcgaacccgtaacg

SEQ ID NO: 336048 - DNA, 650 bp, Homo sapiens
  misc_feature: GZ8MTXP01BTKXN.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgtagcagctaacttagcctggtaccctgacagaaacctggacccaggcctcccgaggtcctcctcatctagtggtcgcactcccaccgacgggccctacgttcggtactcccgagtccgtacggttcaggtcgccgtagggtcggggtctggggactaggtacgtttccacttcctcaacctataccgagccacgtccttgacctagttacgtaggtaagttagttttcggtacggttttaattacggttggtactagtacgtaggttaatacgtaacgttaaccgttgggtacttacgggttaaccgttacgtttcggggaacccgttaaacgggggaccaagggtccgttagggaacgttcggttacggaacgggtccgtaaggttgggtacgttaccttggcctaacccg

SEQ ID NO: 336049 - DNA, 685 bp, Homo sapiens
  misc_feature: GZ8MTXP01B6THK.4.34.D01.1.454.CMB.2.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcagggccagtcagagtgtagcagcaattgctggtacngcagaacnggccngcnccngctcnatctagtgcncactccaccgagggccacgtcggtactcccgagccgtacggttcaggtcgaccgtagggtcgggtacgtggggaactaggtacgttaccaccttccgtaccaaccctacgtaccgaacggccacggtcccgtagtacccgttaggttaccgtaagggtaacgtttacgttttacgggttacggttttaactttacggttacggttaccgtaggttacgttaagttacgttacgtaacgtttaaccggttcggttaccgttacggttaaccgtttaccgggttttaaccgggaaccggttaacgggggtaacccagggtacggtagggttacgttacgttacggaagggtaccgtaaggttcgggtacggttaccgtcggaacccgtaaccg

SEQ ID NO: 336050 - DNA, 598 bp, Homo sapiens
  misc_feature: GZ8MTXP01D2YNH.4.34.D01.1.454.CMB.2.raw
  modified_base (490)..(490): a, c, t, g, unknown or other
  misc_feature (490)..(490): n is a, c, g, or t
  modified_base (559)..(559): a, c, t, g, unknown or other
  misc_feature (559)..(559): n is a, c, g, or t
  modified_base (582)..(582): a, c, t, g, unknown or other
  misc_feature (582)..(582): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgacgggccagtcaggtagtgttagcagactaacttacgcctggtacctgacaagaaacctggcccaggcctcccgaggtcctcctcattctagtggtcactactcccgaccgacgggcctacgtcggtactcccgagccgtacggttcaggtcgccgtagggtcggggtactggggactaggtacgttcactctcacatcgagcagcctgtactagtcgtagtaagttagttttgtacgtttacttacggtgttcgagtactaggtnttaggtattaacggtgtacttacgtacgttcggtttaaggaccggttagggaccttaggcgtaggacgnttacggaaggtacgtaacgtggngttactgaacctaacg

SEQ ID NO: 336051 - DNA, 673 bp, Homo sapiens
  misc_feature: GZ8MTXP01ARYF1.4.34.D01.1.454.CMB.2.raw
  modified_base (315)..(315): a, c, t, g, unknown or other
  misc_feature (315)..(315): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgtagcagctaacttagcctggtacctgacaacgaaacctcggccacggcctcccgacggcctcctcatctagtggtncactccaccgacgggccctacgtcggtactcccgagccgtaacggttcacggtcgaccgtagggttacgggtcgtggggactaggtacgttccacgtcctacgaaccatcacgcgacgccctggactagttacctaaggtaagtttacgttttacggtacggttttttaataccgggttggtacctagtaccgtaggttactagtaacgttaacgtcgggtaccttacgttaaccgttcgggttttcggacccgggttaaacgggggacccaaagggtccggtaagggttacgttcgttaccgggaacgggtaccggtaaccggtttgggacgggttactccgggttaacgtaacccg

SEQ ID NO: 336052 - DNA, 650 bp, Homo sapiens
  misc_feature: GZ8MTXP01EQO94.4.34.D01.1.454.CMB.2.raw
tcagagcactgtagcacgaccggtgctcgatttagatcgtctgtgttgggtttggggggaagaggaagactgacggtccccccaggagttcaggtgctgggcacggtgggcatgtgtgagttttgtcacaagatttgggctcaactttcttgtccctaagactctcctgtgcagcctctggattcacctttagtacctatgccatgggctgggtccgccaggctccgtgggaacgggcctggcgtgggtctcaggaattagtactaggcggtggccatacatactacgcagattccgtagaagggccgattcaccatctccgaggacaactacaagaacacgctgtatctagacaaatcgaacagcctagagaacgaccgaaggacacggtcctttattcgtgtcgacgtaacgtcccgggtggggtggggtattagttatacgtgacctagtcgacgaagtaacgtccggtacggggggggacccgtaacgggggtaaccccttcgggtaccctacccggttcctcccgtaccgaccgtcccctacccgaacccgaacgggcccctacgttcccggtcccttacccccgtggaccccttaccccgttcccaccgaagcgccacccgtcgggacggggccaacggccggg

SEQ ID NO: 336053 - DNA, 703 bp, Homo sapiens
  misc_feature: GZ8MTXP01AEB3B.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagctaacttagcctggtacctgcaagaacctggaccacggcctcccgacggcctccctacatctagtcggtcgaccacgtaccccgaccgacgggggtcccctaacggtttcggtaacctcccccgacggtacccgtaacggggtttaccacgggttcggacccggtaggggtttcggggttccgttaaggggggaacctaaggggtaccggtttaccacccgttccgttacccaaaccctacttaccgacggtacccgacgtcccgtaggacctaggttccgttaaggtaacgtttaacgtttttcgggttacgtttttaacttacgggttcgtaccgtaagtaccttaagttactaggtaacttaaccgtggtacttacgtaccgttcggtttcgggacggttacggggaccaggtcggtagagttcaggaacgacgtaagtggcgttctgcgtaacg

SEQ ID NO: 336054 - DNA, 634 bp, Homo sapiens
  misc_feature: GZ8MTXP01DY521.4.34.D01.1.454.CMB.2.raw
  modified_base (298)..(298): a, c, t, g, unknown or other
  misc_feature (298)..(298): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcgagggccagtcagtagtgttagcagctaacttgcctggtacctgacagaacctggccaggctcccgagcctcctnatctagtggtcacactacccaccgacgggaccctacgttcggtacctcccgagtccctagggttccaggtcgacccgaggttcgggtcgtggggactagtacgttccactctacacctatacgacgcacgtccgtagaccgtagtacgtagtaagttattttacggtacggttttaacttacggttacgttacgtacgtacgtaagttagtacgtaacttaacgtgtacgttacgtacttcggtttaacggacgttaacggggtaccttaaggtcgtaagggagttcgttacggaacgggtacgtaacgtaggtcggactcggttaaccgtaaccg

SEQ ID NO: 336055 - DNA, 596 bp, Homo sapiens
  misc_feature: GZ8MTXP01D11WE.4.34.D01.1.454.CMB.2.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (556)..(556): a, c, t, g, unknown or other
  misc_feature (556)..(556): n is a, c, g, or t
  modified_base (578)..(578): a, c, t, g, unknown or other
  misc_feature (578)..(578): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcaggagtgttagcagcaacttagcctggtactgacagaaacctggccaggctccgaggcctcctnatctagtggtncatcccacgacgggcctacgtgtacctccgagtcccgtaggttcagtcgccgtaggtcgggtctggggactaggtacttccgactcgtcaccctgtacacgcacgtcctagactgtactgtaagttacgttttgacggttttattacggtcgtgtagcgtaagtacttagtaagttaaccgtgggtaccttagttaacgttcgtttaacgggaccgttacggggtaaccttaggtacgtagggttaacgngttacgaaggtcgaacgttggnggttactcgttcctaacg

SEQ ID NO: 336056 - DNA, 560 bp, Homo sapiens
  misc_feature: GZ8MTXP01ER8TX.4.34.D01.1.454.CMB.2.raw
  modified_base (308)..(308): a, c, t, g, unknown or other
  misc_feature (308)..(308): n is a, c, g, or t
  modified_base (521)..(521): a, c, t, g, unknown or other
  misc_feature (521)..(521): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgtagcagctaacttagcctggtacctgacagaaacctggaccaggcctccgaggcctcctcatctatggtncactccacgacgggccacgtggtactcccgagcctaggttccaggtcgccgaggtcgggtcgtggggacagtacgttcacttctccactatcagcacgcctgactagtactagtaagttagtttcgtacgtttattacgtgttacagtactagtagtagtattaacgtgtctagtactcgtttggaccgttagggaccgaggtcgtagggagngttcgaacgggcgtaacgtggtcgcgtcgaaccgtaacg

SEQ ID NO: 336057 - DNA, 720 bp, Homo sapiens
  misc_feature: GZ8MTXP01BC9N7.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgccaccctctcctgcgagggccagtcagagtgttagcagcaacttagcctggtacctgacaacgaaacctggaccacggcctcccgaggcctcctcaatctagtcgggtcacactccccaccgacgggccctacgttcggtacctcccgagtcccgtaggttccaggtcgacccgtagggttcggggtaccgtggggaactacgggtacgtttacccaaccgttcctaccaacccgtactaccgacgaccacgtcccgtaggtaccctagttccgttaaggtaaaggtttacgtttttaggttaccggtttttaattaccgggttgttacccgtaaggtaccgtaagttaagttagtaaacgtttaaaccgtcggtaactttacggttaaacctttccgggttttaaccgggaaccggttaaacgggggtaacccaaagggtccggttaagggaaccgttagttaccggaaggggtacgtaacggtggtacgggccttcggaacccttaaccg

SEQ ID NO: 336058 - DNA, 673 bp, Homo sapiens
  misc_feature: GZ8MTXP01EJCMW.4.34.D01.1.454.CMB.2.raw
  modified_base (312)..(312): a, c, t, g, unknown or other
  misc_feature (312)..(312): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcagggccagtcagagtgtagcagcaacttagcctggtacctgacaagaaacctggcccaggcctcccgaggcctcctcatctagtggtcnctactcccacgacgggcctacgtggtactcccagcctacggttcagtcgaccgtagggtcgggtcgtggggactaggtacgttccaccttaccgtccaacctataccgacgcgacgccgtagacgtacgttacgtagtaagttacgttttcggttacggttttacttacggttagtacgtaagtacgtaagttagtagtaacgttaacgtcgtacgtttacgttaaccgttcggttttaaccgggaacggttaacgggggtaaacccgttaaggtccggttaagggaacgttacggttacccggtaaggggtaccgttaaccggttgggtccggttacgttaacggttaacccgttaaccg

SEQ ID NO: 336059 - DNA, 665 bp, Homo sapiens
  misc_feature: GZ8MTXP01EA4DM.4.34.D01.1.454.CMB.2.raw
  modified_base (308)..(308): a, c, t, g, unknown or other
  misc_feature (308)..(308): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagacaacttagcctggtacctgacagaaacctggccaggcctcccaggcctcctcatctatggtcncaactcccaaccgacgggcccacgtggtacctcccagcccgtaggttccagtcgcccgtaggtcggggtactgggggactaagggtacgtttccaaccttctaccaaccactcaagcacgccgtgaccgtagtcgtagtaagttagttttcggtacggttttacttaacggttgtacgtagtctaaggtataggtaattaaaccgttggtacgttacgttaaccgttcggttttaacgggacccgggttaaacgggggtaacccgttaaaggtccggttaagggaacggttacgttaccgggaacgggtaacggtaaaccggtggggtcgggttacttaacggaacccgttaacccg

SEQ ID NO: 336060 - DNA, 549 bp, Homo sapiens
  misc_feature: GZ8MTXP01BVXHF.4.34.D01.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctnatctatggtncatcccacagggccactggtactcccagccaggttcagtcgccctaggtgggtctggggacaggtagttcactctcaccatcagcagcctgcagtctgtaagtntttgtacggtttattacgttgtctagctagtatgtaattaacgtggtcttagttactcgtttcgggaccgttagggggacccaaggtcgtagggacgttgttacgaagggcgtaacgttgggtacgggttctcggccgtaaccg

SEQ ID NO: 336061 - DNA, 583 bp, Homo sapiens
  misc_feature: GZ8MTXP01DE554.4.34.D01.1.454.CMB.2.raw
  modified_base (298)..(298): a, c, t, g, unknown or other
  misc_feature (298)..(298): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagactaacttagcctggtacctgacaagaaacctggccaggcctcccaggcctcctnatctagtggtcgcactcccaccgacgggtcccacgttggtactcccgagccgtagggttcaggtcgaccgtaggtcgggtactgggacaggtacgttccacgtctacaccactcagcagcctgctagtctagtaagttatttgtacgtttattacgtgtcgtagtcgtagtatagtataacgtgtctgttacttcgtttcggcggttaggggtaccaaaggtcgtaggttaacgagttacgaagggtacgtaacggttcggtcggttacctcgaaccgtaacccg

SEQ ID NO: 336062 - DNA, 652 bp, Homo sapiens
  misc_feature: GZ8MTXP01CZ8I7.4.34.D01.1.454.CMB.2.raw
  modified_base (401)..(401): a, c, t, g, unknown or other
  misc_feature (401)..(401): n is a, c, g, or t
  modified_base (592)..(592): a, c, t, g, unknown or other
  misc_feature (592)..(592): n is a, c, g, or t
tcagagcactgtagcacgaccggtgctcgatttagatcgtctgtgttgggtttggggggaagaggaagactgaccggtccccccaggagttcaggtgctgggcacggtgggcatgtgtgagttttgtcacaagatttgggctcaacttttcttgtcccctaagactctcctgtgcagcctctggattcacctttagtacctatgccatgggctggggtccgccaggctccgtggggaagggcctggcgtgggtctcgaggaattagtactaggcggtgccatacatactacgcagattccgtagaagggccgattcacatctcaggacaactacaagacacgctgtatctgacaaatcgaacagcctagagaacgccgaaggacacgggtccgtttattcngtgacgaaacgtccgggtggggggtattagtatacgtgtccgtagttcgacgagtaacgtccgtacggggccgtaacggggaccccgttcgggtaccgaacccggttcctcccgtcgaccgtccctaccgaccgaaacgggcccctaacgtcccggttcccgttcccccgcggtcccctccccgttacccnccgttaaacgccgtacccgaacccgtcgggtcgggggcctaaccggaacgggtccccggg

SEQ ID NO: 336063 - DNA, 609 bp, Homo sapiens
  misc_feature: GZ8MTXP01CTP2H.4.34.D01.1.454.CMB.2.raw
  modified_base (313)..(313): a, c, t, g, unknown or other
  misc_feature (313)..(313): n is a, c, g, or t
  modified_base (486)..(486): a, c, t, g, unknown or other
  misc_feature (486)..(486): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcacgggccagtcaggagtgttagcagctaacttacgcctggtacctgacaagaaacctggccaggcctcccgagcctcctcatctatggtcncactcccacgacgggccctacgtggtacctcccagcccgtaggttccaggtcgacccgtagggtcgggtcgtggggactaggtacgttccactctacacatcacgtcagcctgctagtctagtaacgttagtttcggtacgttttaacttacggttcgtacgagtcgtaagtntagtacgttacgtgggtacttggttacctcgggtttcggacggttaacggggtaccttaggtcgtaggttacgttggttaccggaagggtacgtaacggtgggtacggctcggttcgtaaccg

SEQ ID NO: 336064 - DNA, 635 bp, Homo sapiens
  misc_feature: GZ8MTXP01DRGRU.4.34.D01.1.454.CMB.2.raw
  modified_base (303)..(303): a, c, t, g, unknown or other
  misc_feature (303)..(303): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagtagtgttagcagacaacgttagcctggtacctgacaacgaaacctggccaggctcccgaggcctcctnattctagtggtcgactactcccgaccgacgggggtcccaacgttcggtacctcccgaggtccctaagggttccaggtcgacccgtagggtcggggtactgggggactaggtacgtttccacttctacacctatcacgtcacgcctgactagtctagagttgtttcggtagtttattacggtgtacgagactagtacgtagtaattaacgtggtcttacgttacgttacggtttaacggaccggttaagggggaaccttaaaggccggttagggaacgttgttaaccgggaagggtacgtaacggttgggcggttcgtaacgttcccgtaacg

SEQ ID NO: 336065 - DNA, 628 bp, Homo sapiens
  misc_feature: GZ8MTXP01BZJ9H.4.34.D01.1.454.CMB.2.raw
  modified_base (293)..(293): a, c, t, g, unknown or other
  misc_feature (293)..(293): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgagggacagacgcccaccctctcctgcgagggccagtcagagtgttagcagcaacttagcctggtacctgcagaaacctggccaggctcccaggctccnatctatggtgcactcccaccgagggcccacgtggtaacctcccgagtcccgaaggtttcagtcgccgtaggtcgggtctggggacaggtacgtttccaactctcgaaccctatacgacgcacgcctagcgtagttctaggtaagttcgttttgtacgggttttattacggttgtcgagcgtaagttagtagtaacttaaacgtgggtaccttaggttaccttaacggttttcgggacccgttaacgggggacccgaaggtaccgttggggaacgttacgttcccggaagggtaccgtaaccggtggtcgggttcgttcgaacccggttaaccccg

SEQ ID NO: 336066 - DNA, 566 bp, Homo sapiens
  misc_feature: GZ8MTXP01CQ6SC.4.34.D01.1.454.CMB.2.raw
  modified_base (310)..(310): a, c, t, g, unknown or other
  misc_feature (310)..(310): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagctaacttagcctggtacctgacaagaaacctggccaggcctcccgaggcctcctcatctagtggtncatccaccgagggccacgtggtactcccgagccgtaaggttcaggtcgacccgtagggtcgggtctggggactaggtacgtttccactctacaacctatacgacgcagccctggactacgttcgtagtaagttagtttgtacggtttattacgttgtactagtcagtatgaataacgtggtctagtactcgtttcggcgttaggggaccagtcgtggagttgttcgaaggacgtaacgtggtacgctcgcgtaacg

SEQ ID NO: 336067 - DNA, 623 bp, Homo sapiens
  misc_feature: GZ8MTXP01DQGHL.4.34.D01.1.454.CMB.2.raw
  modified_base (300)..(300): a, c, t, g, unknown or other
  misc_feature (300)..(300): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgtagcagctaacttagcctggtacctgacacgaaacctggccaggcctcccgaggcctcctnatctagtggtcgacctactcccgaccgacgggcctacgtcggtacctcccgagccgtaggttcaggtcgccgtaggtcgggtctggggactagtacgttccactctacactatcgagtcacgtcctgacgtagtactagtaagttagtttggtacgttttattacggttcgtacgacgtactagtagtagtaacgttaacgtggtacgttacgttaccgttcggtttaacgggaccggttaacggggaaccttaaggtacggtaggaacgttcgttaccggaacgggtaccgtaaggttcggtcggttctcggaacctaaccg

SEQ ID NO: 336068 - DNA, 494 bp, Homo sapiens
  misc_feature: GZ8MTXP01AD37E.4.34.D01.1.454.CMB.2.raw
  modified_base (301)..(301): a, c, t, g, unknown or other
  misc_feature (301)..(301): n is a, c, g, or t
  modified_base (468)..(468): a, c, t, g, unknown or other
  misc_feature (468)..(468): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccagggccactggtatcccagccaggttcagtgccagtgggtctgggacagagttcactctcaccatcagcagcctgcagtctgaagtatttgacggtttattacgtgtcagcagtatgataactggtctgtactgtttggccaggggaccaagctggagnttcaaggcgaacgtgtggctgcaacc

SEQ ID NO: 336069 - DNA, 571 bp, Homo sapiens
  misc_feature: GZ8MTXP01BVB7F.4.34.D01.1.454.CMB.2.raw
  modified_base (304)..(304): a, c, t, g, unknown or other
  misc_feature (304)..(304): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagcaacttagcctggtacctgcagaaacctggccaggctcccaggcctcctcatctatggtncatccacgacgggccacgtggtactcccgagccgtacggttcaggtcgcctaggtcgggtctggggacaggtacgttcacgtctcaccatcagcacgcctgactagtctagtaacgttagtttgtacggttttattacggtgtcgtacgtactagttatgtattaacgtggtcttagtacttcgtttcggccgttacggggaccaggtcgtagggagttcgttacgaacgggtacgtaacgtgggtacggttcgttcgcgtaacccg

SEQ ID NO: 336070 - DNA, 521 bp, Homo sapiens
  misc_feature: GZ8MTXP01CR7D7.4.34.D01.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
  modified_base (490)..(490): a, c, t, g, unknown or other
  misc_feature (490)..(490): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccacctctcctgcagggccagtcagagtgttagcagcaacttagcctggtacctgcagaaacctggccaggctccaggctctnatctatggtncatccacagggccagtggtactcccagccacggttcagtgcctaggtcgggtctgggacaggtacgttccactctcaacatcagcagcctgctagtctagattntttgacgtttatcgtgtcagctagtagtanattaacgtgtcttagtacttcgtttcggacgaggggtacccaggtcgtaggagttncgaaggcctaagtggtacggctaagcgtaac

SEQ ID NO: 336071 - DNA, 595 bp, Homo sapiens
  misc_feature: GZ8MTXP01BLAAF.4.34.D01.1.454.CMB.2.raw
  modified_base (382)..(382): a, c, t, g, unknown or other
  misc_feature (382)..(382): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagagccacactctcctgcagggccagtcagagtgtagcagcaaacttgcctggtacctgacaagaaacctggccaggcctcccgaggcctcctcatctagtggtgacactccaccgacgggcctacgttcggtactcccgagtccccgtaggttcagtcgcccgtaagggtcgggtcgngggaccaggtacgttcactctaccacatcagcagctagctagtcgtagtaagttgtttacgtacggttttatacgttgtcagtactagttatacgtaattacgtggtacttacgtaacgttaacgtttcgggaccggtacggggttaaccgaaaggtcgttagggagttacgtaaccggaggtaaccgtaacgtggcggtaaccttggaaccc

SEQ ID NO: 336072 - DNA, 614 bp, Homo sapiens
  misc_feature: GZ8MTXP01EIUC9.4.34.D01.1.454.CMB.2.raw
  modified_base (295)..(295): a, c, t, g, unknown or other
  misc_feature (295)..(295): n is a, c, g, or t
  modified_base (579)..(579): a, c, t, g, unknown or other
  misc_feature (579)..(579): n is a, c, g, or t
tcagagcactgtagcacgaccggtgctcgatttagatcgtctgtgttgggtttggggggaagaggaagactgacggtccccccaggagttcaggtgctgggcacggtgggcatgtgtgagttttgtcacaagatttgggctcaacttttcttgtccctaagactctcctgtgcagcctctggattcacctttagtacctatgccatgggctgggtccgccaggctccgtgggaaggcctggcgtgggtctcaggaattagtactagcggtgccatacatactacgcagattccgngaagggccatcaccatctccgaggacaactcaagaacacgctagtatctgacaaatcgaacagcctgagaacgaccgaaggacaccgggtcctttattcgtgtacgacgtaaacgtcccggggtaggggggtattagttatacgtacgacctagttcgacacgtaacgtcgtcggggaccgacggggtaacccgtcgggtccaccgtcctccgtcgaaccgcctaccaccgtaacggcccaacgtccggttccctccccgttgccctacccttccttccacgcnccgaacccgtcggtcggggacaaccgcgccccggg

SEQ ID NO: 336073 - DNA, 564 bp, Homo sapiens
  misc_feature: GZ8MTXP01CVQSF.4.34.D01.1.454.CMB.2.raw
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagactaacttagcctggtacctgacaagaaacctggccaggctcccaggcctctnatctatgcncacnccacgagggccagtgtaccnccgagccgtaggttcagtgcccgtaggtcgggtctggggacaggtacgttccaacgtctacacatcagcacgcctagactagtctagtaattgtttggtacgtttattacgtgtcaagctaagtatagaataacgtggtacctagttaacttcgtttcgggacccgttagggggaaccaaggcgtgggaaacgttgacgaagggacgtaacgttgggacgttccgtgcctaacg

SEQ ID NO: 336074 - DNA, 658 bp, Homo sapiens
  misc_feature: GZ8MTXP01ERCWX.4.34.D01.1.454.CMB.2.raw
  modified_base (348)..(348): a, c, t, g, unknown or other
  misc_feature (348)..(348): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgttagcagctaacttacgcctggtacctgacaacgaaccgtcggccacggcctcccgaggcctcctcatctagtggtcgcactaccgaccgacgggcctacgtcggtacncccgacgccgtacggttcaggtcgcccgtaggtgggtcgtgggactaggtactttccaccttctacaaccgtactacgacgacacgtcctgacgtacgttcgtaggtaacgttagttttacggttacggttttaacttacggttagttacgtacgtacgtagttaacgtagtaacttaacgtcggtacttaggttaaccgttacggtttaacgggaccggttaacggggtaaccgaaggtacggtaggacgttacgttacggtaacgggtacgtaacggttcgggtacggttcgtccgttccggtaaccg

SEQ ID NO: 336075 - DNA, 593 bp, Homo sapiens
  misc_feature: GZ8MTXP01EYSZ0.4.34.D01.1.454.CMB.2.raw
  modified_base (313)..(313): a, c, t, g, unknown or other
  misc_feature (313)..(313): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgttagcagctaacttagcctggtacctgacaagaaacctggccaggcctcccgaggcctcctcatctagtggtcncactcccaccgacgggcctacgtggtacctcccgagccgtacggttcaggtcgcccgtaggtcggggtcgtggggacaggtacgttccaacgttcctacaaccatacagccacgcctagacgtagttacgtagtaaagttagttttcggtacgttttattacggtgttacgagtcgtaagtatgtaacttaacgtggtacttagtaccgttgtttcgggacgttagggtaccaggtcgtaggagttattcggaaggacgtaagtggcggctgccgtaacg

SEQ ID NO: 336076 - DNA, 539 bp, Homo sapiens
  misc_feature: GZ8MTXP01AM139.4.34.D01.1.454.CMB.2.raw
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccacagggccacgtggtactcccagccaggttcagtcgccaggtcgggctgggacaggagttccactctcaccatcagcagcctgcagtctgaagtntttgcgtttatacgtgtcagctagtntcgtataaccgtggctagttacgtcgttttaacggccgagggggtacccaaggtccgtagggagacgttcggaagggtccgtaaacgttggtcggttcgtcggcctaacccg

SEQ ID NO: 336077 - DNA, 767 bp, Homo sapiens
  misc_feature: GZ8MTXP01A7M1D.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagcccaccctctcctgcgagggccagtcagtagtgttagcagactaacttacgccgtggtacctgacaagaacctggcccaggcctcccgaggccctcctcatccgtagtggtcgaccacgtccccaaccgacgggccctacgtacggtacctccccgagtcccgtaaggttccaaggttcgacccgtagggttcggggtcccgttggggaactacggttacgtttaccaccgttcccgtaccaaaccctaacttccgaacggaccgaaccggtcccgttggaccgtaacggttaccgtaaggttaaacgtttacgtttttacgggttaacccgggtttttaattaccggtttaggtaaccgtaaggtaacccgttaagggttaacttaggttaaacttaaacccggttggttaccgtttaacggttaaaccctttacgggttttccgggaacccgggttaaacgggggaaccccttaaaggtccggttaagggaaccgttagttacggaacgggtacccgtaaacggttgggttaccgggaacctcggttaaccgtaacccg

SEQ ID NO: 336078 - DNA, 731 bp, Homo sapiens
  misc_feature: GZ8MTXP01AXOI0.4.34.D01.1.454.CMB.2.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (685)..(685): a, c, t, g, unknown or other
  misc_feature (685)..(685): n is a, c, g, or t
  modified_base (730)..(730): a, c, t, g, unknown or other
  misc_feature (730)..(730): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacaggacncccacctctcgngacgcggcagtacgagtgttagtacgacacactaacgtacgcgttacggtactgacgaaacgtaaccgtcggaccgacggtcccaccggacgtccctcctactacgttacgtaggttacgggtcacctaccgtaccccgaccggtacccgggacccttacggtacggttacccaccgacgtaccgttacggtccgttaggccgtaccgtggggtcgggtcggtaagggaccgtagttaccgttccacgttccaccacctagacgacgacgacgtcctgaccgttagttacgtaagttaaagtttcggttttacggttacggtttttaaactcggggttacgtaacgttacgaccgtttaaaggttagtacgtaacccttaaggggttccgttaacgttacgttaaccggttttcgggttcccgggaacgggttaaccggggtaacaccgggtaggtagggttaancggttacggaacgggtactggtacggtccggttactccgttaacng

SEQ ID NO: 336079 - DNA, 581 bp, Homo sapiens
  misc_feature: GZ8MTXP01EAQ9P.4.34.D01.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagagcactgtagcacgaccggtgctcgatttagatcgtctgtgttgggtttgggggaggaactgctcagttaggacccagacggaaccatggaagccccagcgtagcttctcttcctcctgctactctggcctcccagaaaccactggagaaatagtgatgacgcagtctccaggcaccctgtctgtgtctccgaggggacagacgccaccctctcctgcagggccagtcagagtgtagcagcaacttagcctggtacctgcagaaaccnggccagctccaggctcctcatcatggtncactccaccgaggcccaacgtcggtactcccagccgtaggttcccaggtgcctaggtgggtacctggggaacagtacgttcacgtccacaccatcagcacgcctgctagtctagtaagttatttgtacggtttattacgtggtactagtactaagtaagtcgaattaacgtggtcgtagtacttacggtttcgggaaccgtaacgggggaccaaaggttcgtaaggagttagttcggacggaacggtaagtcggtagggcttggaaccgttaacccgtaag

SEQ ID NO: 336080 - DNA, 657 bp, Homo sapiens
  misc_feature: GZ8MTXP01BY9XO.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagcaacttagcctggtacctgacaagaaacctggcccaggcctcccgaggcctcctcatctagtggtgccactcccaccgagggcccacgtggtactcccgagccgtaggttcagtcgcctaggtcgggtctgggacaggtagttccactctacaccatcagcacgcctcgactacgttacgtagtaagttagttttacggttacgggttttaactttacggttacggttacgtacggtacgtaaggttaagttacggtaacttaaacgttggtaccgttagttaccgttacggttttaacgggacccgggttaacggggtaacccgttaaacggtaccgtagggttaacgttacgttacggtaacgggtacgtaaccgttcgggtacgggttccgttccgttaaccgtaacccg

SEQ ID NO: 336081 - DNA, 587 bp, Homo sapiens
  misc_feature: GZ8MTXP01CT9LR.4.34.D01.1.454.CMB.2.raw
  modified_base (312)..(312): a, c, t, g, unknown or other
  misc_feature (312)..(312): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgccaccctctcctgcagggccagtcagagtgtagcagcaacttgcctggtacctgacaagaacctggacccaggcctcccgaggcctcctcattctagtggtacncacgtcccgaccgacgggcccaacgtggtacctcccgagtaccgtaacggtttcacgtcggaccgtaggtcgggttcgtaagggggacaaaggtacgtttcacctctaccaacgatcgagcacgcctgactaggtctagtaagttctttggtacgttttactaacgtgtactagctagtatgaataagtggtacttagtacttacgttcgggacgttagggaccaagtgtcggagcttcggaaggtacgtaacgtaggtcggactcggctaaccg

SEQ ID NO: 336082 - DNA, 692 bp, Homo sapiens
  misc_feature: GZ8MTXP01BSRM3.4.34.D01.1.454.CMB.2.raw
  modified_base (310)..(310): a, c, t, g, unknown or other
  misc_feature (310)..(310): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagagtgtagcagcaacttgcctggtacctgacaacgaaccgtggaccaggcctcccgagcctcctcatctatggcncactccgacgacgggcctacgtcggtaactcccgagcctacggttcagtcgccgtaggtcgggttctggggactaggtacgtttccacttcctacgaacctacgtacacggacacggtccctgaccgtagttcttaggtaagtttacgttttaggttaccgttttaagttaccgttgttaccgagtacgtaagttagtaggtaactttacggtggtacctttaggttaacccgtttcgggttttaaccgggaacccggttaaacgggggtaaccccttaagggtacggttacggggttaaacgttaccggttacgggtaaccggggtcgttaaacggtttcggggtaaccgggttccgttaaccggttaacccgttaacccg

SEQ ID NO: 336083 - DNA, 511 bp, Homo sapiens
  misc_feature: GZ8MTXP02HC88J.4.34.D01.1.454.CMB.2.raw
  modified_base (289)..(289): a, c, t, g, unknown or other
  misc_feature (289)..(289): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaacctggccaggctcccaggctcctnatctatggtgcatccaccagggccactggactcccagccaggttcagtgccagtgggtctggggacagagttcactctcaccatcagcagcctgcagtctgaagtatttgtcggtttattactgttcagtcagtatgataactggtctagtactacgtttcggccgtaggggaccaagcgtaggacgagtacgaaggacgtaacgtggtggcgtcgacaccg

SEQ ID NO: 336084 - DNA, 492 bp, Homo sapiens
  misc_feature: GZ8MTXP02FWKET.4.34.D01.1.454.CMB.2.raw
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccacctctcctgcagggccagtcagagtgttagcagcaacttagcctggtacctgcagaaacctggccaggctcccagctcctcatctatggtgcatccaccagggccactggtactcccagccaggttcagtgccagtggtctggggacagagttcactctcaccatcagcagcctgcagtctgaagtatttgcggtttatactgtcagcagtatgataactggctgtacactttcggcctaggggaccaaagctggacgatcgaaggcgaaactgtggctgcaacc

SEQ ID NO: 336085 - DNA, 518 bp, Homo sapiens
  misc_feature: GZ8MTXP02HRD6S.4.34.D01.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctnatctatggtncatccacagggccactggtatccccagccaggttcagtgccagtgggtctggggacagagttcactctacaccatcagcagcctgcagtctgaagtatttgcggtttattactgttcagctagtatgataactggtactgtactacgttttcggaccgtagggggaccaaaggcgtaggagacgtcgaagggcgaaacgtggtggtcgtcgacaaccg

SEQ ID NO: 336086 - DNA, 508 bp, Homo sapiens
  misc_feature: GZ8MTXP02H4D37.4.34.D01.1.454.CMB.2.raw
  modified_base (290)..(290): a, c, t, g, unknown or other
  misc_feature (290)..(290): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctnatctatggtgcatccaccagggcccactggtaactcccagccaggttcagtgccagtgggtctggggacagacgttcactctcaccatcagcagcctgcagtctagaagtatttgcggtttattactgtcagcagtatgataactggctagtactactttggccgtaggggaccaaagcgtaggacgagtcgaaggcgaacgtgtaggcctgacaccg

SEQ ID NO: 336087 - DNA, 586 bp, Homo sapiens
  misc_feature: GZ8MTXP02HOXK8.4.34.D01.1.454.CMB.2.raw
  modified_base (179)..(179): a, c, t, g, unknown or other
  misc_feature (179)..(179): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
tcagagcactgtagcacgaccggtgctcgatttagatcgtctgtgttgggtttgggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggcaacatacgccttctccgtcccccttcgcagtaacaccaagtacaggaatattaacctgttcccatcgactacgccttcggcctcgccttagggcactcaccctgccccgattaacgtgacagaccctgtctccggngagcggctttcgaccgtnttactccgttactatgtcagtcacttcgctacttctgactacctcagcatcncncacacacactacctacacacgtactacacgaaccacctaccctaacccaaccaaccacaactaacgacgtcgcgtcgcgacgacgtcgtcgtcgtacgtacgttacgttaccgttacccgttaccgtaacgttccgttcccgtcctactactacgtacgtacg

SEQ ID NO: 336088 - DNA, 527 bp, Homo sapiens
  misc_feature: GZ8MTXP02IGBF7.4.34.D01.1.454.CMB.2.raw
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (420)..(420): a, c, t, g, unknown or other
  misc_feature (420)..(420): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccagggcccactggtactccccagccaggttcagtcgccagtcggggtctggggacagngttcactcncaccatcagcagcctgcagtctgaagtatttgcggtttattctgtnagcagtatagattaacgtggtctgtactacgttttcggaccgtagggggaacccaaaggtcgtagggagagtcgaagggtcgaacgtcggtaggcctggaccaaccg

SEQ ID NO: 336089 - DNA, 502 bp, Homo sapiens
  misc_feature: GZ8MTXP02JQ4PA.4.34.D01.1.454.CMB.2.raw
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtncatccaccagggccactggtactcccagccaggttcagtgccagtgggtctggggacngagttcatctcacatcagcagcctgcagtctagagtatttgcggtttattactgtcagcagtatgatacgtgcttgtactacgtttcggcgtacggggacctaaggcgtaggagagtcgaaggcgaacgtgtgctcgacacc

SEQ ID NO: 336090 - DNA, 574 bp, Homo sapiens
  misc_feature: GZ8MTXP02HIIMK.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtgcatcccaccgagggcccactcggtactccccgaagccctaagggttcagtcgccgaggttcgggtctgggggacagtagttccactctcacccatcagcagcctgcagtctagatatttgtcggtttattactgttcagtctagtatagtaataacgtggtacttagtacttacgttttacggacccgaagggggtacccaaaggtcgttacgggaagtaacgtacggaacgggacgtaaaccgtcggtgggaccttcgggtacctaacccg

SEQ ID NO: 336091 - DNA, 534 bp, Homo sapiens
  misc_feature: GZ8MTXP02JHBKH.4.34.D01.1.454.CMB.2.raw
  modified_base (301)..(301): a, c, t, g, unknown or other
  misc_feature (301)..(301): n is a, c, g, or t
  modified_base (500)..(500): a, c, t, g, unknown or other
  misc_feature (500)..(500): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccaggggcccacgttggtactccccgagccctagggttccagtcgcctaggtcggggtctgggggacaggacgttcactctccacatcagcagcctgcagtctgaagtatttgtacggtttattacgtgtcagtctagtatgatacgtggtctagtactcgtttcggccgtaggggaccaaggcgtaggacgngtacgaaggcgtaacgtggtaggctcgactaccg

SEQ ID NO: 336092 - DNA, 536 bp, Homo sapiens
  misc_feature: GZ8MTXP02J037I.4.34.D01.1.454.CMB.2.raw
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatcccaccgagggcccacgtggtactcccgagccctaggttccagtcgcctaggtcgggtctgggggacaggagttcactctacaccatcagcacgcctgcagtctagaagtagtttgtacggtttattacgtgtcagtctagtatgtatacgtgtctagtactacgtttcggaccgtaggggaccaaggcgtaggacgtagtcgaaggtacgaacgtggtaggctcgactacg

SEQ ID NO: 336093 - DNA, 506 bp, Homo sapiens
  misc_feature: GZ8MTXP02HTFQJ.4.34.D01.1.454.CMB.2.raw
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccacagggccactggtactcccagcccaggttcagtgccaggtcggtctggggacagagttccactctcaccatcagcagcctgcagtctgaagtatttgtcggtttattacttgtcagcagtatagataacgtgctgtactacgtttcggcgtaggggaccaagtctgggaacagagaaggacgacgtcgtgtctcgacacg

SEQ ID NO: 336094 - DNA, 511 bp, Homo sapiens
  misc_feature: GZ8MTXP02GDCNY.4.34.D01.1.454.CMB.2.raw
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccagggccactggtatcccagccaggttcagtgccagtggtctggggacaggagttcactctcaccatcagcagcctgcagtctgaagtatttgacggtttattactgtcagctagtatgataactggctgtactacgtttggccgtaggggacctaaagcgtaggacgagtacgaaggacgaacgtggtaggctcggacaacc

SEQ ID NO: 336095 - DNA, 566 bp, Homo sapiens
  misc_feature: GZ8MTXP02F40KE.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtgcatccaccagggccactggtactcccagccaggttcagtgccagtgggtctggggacagagttcactctcacatcagcagcctgcagtctgaagtagttttgtacggttttattacgttgtacagtacaagtatagtattaacgtggtcttagtaccgttacgttttcgggaccgtaacgggggtacccaaaggtccgttacgggaacgtacgttacgaacgggtaccggaaaccgttgggtcggtacgttcggacctaacccg

SEQ ID NO: 336096 - DNA, 574 bp, Homo sapiens
  misc_feature: GZ8MTXP02I5EZJ.4.34.D01.1.454.CMB.2.raw
  modified_base (523)..(523): a, c, t, g, unknown or other
  misc_feature (523)..(523): n is a, c, g, or t
  modified_base (545)..(545): a, c, t, g, unknown or other
  misc_feature (545)..(545): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcacctgccccgattacgtgacaggaaccctggtctccggcgagcggtctttcaccgctttatccgttactatgtcagcattcgctacttctgactaccctccaagccatcgccctcacagccacaccttcacacgccttacacgaaaccgccctacccctaacccaacaacgcaataacgccgtcgctcgccgcacgcttcggcnctagttcgttacgccccgtttnaacgttccttcccgctactctcgactacg

SEQ ID NO: 336097 - DNA, 616 bp, Homo sapiens
  misc_feature: GZ8MTXP02H9GM7.4.34.D01.1.454.CMB.2.raw
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggccaccctgtctgtgtctccgaggggacagacgccacactctcctgcagggccagtcagagtgtagcagcaacttagcctggtacctgacaagaaacctggccaggcctccccgaggtcctcctcatctatggtnactactcccacgagggccacgtcggtactccccgagccccgtaggttcacggtcgccgtagggttcgggtcgtaggggactaggtacgttaccactcctacacctancagacncgcctagacagttctaggtagttgtttaggttaccggttttatttacgttgtacgtaggtactaaggttatagtacgttaacgtgggtacttacggttaacttcggtttacgggaccggtaacggggaccctaaggccggttacggagtacgtaaccggaggtaccggtagtcgggttacgcgttacgaccg

SEQ ID NO: 336098 - DNA, 512 bp, Homo sapiens
  misc_feature: GZ8MTXP02GYGNR.4.34.D01.1.454.CMB.2.raw
  modified_base (302)..(302): a, c, t, g, unknown or other
  misc_feature (302)..(302): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctccccaggcctcctcatctatggtncatccaccagggccatggatcccagccaggttcagtgccagtgggtctggggacagagttcactctcaccatcagcagcctgcagtctagaagtattttgtacggtttattactgtcagtcagtatgatactggctgtactacgttttcggccgtaggggaccaaggcgtaggaacgtagtcgaaggcgaacgtcggtgctcgctaaccg

SEQ ID NO: 336099 - DNA, 556 bp, Homo sapiens
  misc_feature: GZ8MTXP02JI470.4.34.D01.1.454.CMB.2.raw
  modified_base (414)..(414): a, c, t, g, unknown or other
  misc_feature (414)..(414): n is a, c, g, or t
tcagagcactgtagcacgaccggtgctcgatttagatcgtctgtgttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttagggtcgactcacctgccccgataacgttggacaggaacccttggtcttccggcgagcgggctttcacccgctttatcccgttacttatgtcagcattcgcacttctgntacctccagcatgcctcacagcacaccttcacagcttacagaacgctccccaccaacaacgccataacgcgtcgctgccgcacgcttcggtcgcatcggttacgccccgtttcaatcctttcccgctactctacgacttacg

SEQ ID NO: 336100 - DNA, 517 bp, Homo sapiens
  misc_feature: GZ8MTXP02JB8PF.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccgagggccactggtactcccagccaggttcagtgccagtcgggtctggggacaggacgttcactctcaccatcagcagctgcagtctagagtatttgtcggtttattactgtcagcagtatgataacgtggctagtactacgttttcggccgaggggtaccaaggcgtaggacgatacgaaggacgtaaacgtggtggctcgacaaccg

SEQ ID NO: 336101 - DNA, 536 bp, Homo sapiens
  misc_feature: GZ8MTXP02JOFEJ.4.34.D01.1.454.CMB.2.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (368)..(368): a, c, t, g, unknown or other
  misc_feature (368)..(368): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccacagggccatgtacnccagccagttcagtgccaggtggctggggacagagttccactctacnccatcagcacgcctgcagtctagaagtatttgtacggtttattacgttgtacagtcgtaagttagtaggaattaacgtggtctagtactacgttttacggaccgtagggggaccaaaggcgttagggacgtagtccgaaggcgaaacgtcggtggctcggactaaccg

SEQ ID NO: 336102 - DNA, 499 bp, Homo sapiens
  misc_feature: GZ8MTXP02IZCAI.4.34.D01.1.454.CMB.2.raw
  modified_base (293)..(293): a, c, t, g, unknown or other
  misc_feature (293)..(293): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctccccaggcctcctnatctatggtgcatccaccagggccatggatcccagccaggttcagtgccagtgggctggggacaggagttcactctcaccatcagcagcctgcagtctgaatatttgtcggtttattacttgtcagcagtatgataactggtctagtactacttttcggcctaggggaccaaagcgtgacgatcgaagcgaacgtgtcggctgcac

SEQ ID NO: 336103 - DNA, 519 bp, Homo sapiens
  misc_feature: GZ8MTXP02I4RV5.4.34.D01.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggaaccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctnatctatggtncatccacagggccactggtactccccagccaggttccagtcgcctaggtcggggtctgggggacaggagttccactctcaccatcagcagcctgcagtctgaagtattttgtacggtttattacttgtcagtcagtatgataactggctgtactacgtttcggccgtaggggaccaagcgtaggagatacgaaggcgaacgtggtggctcggacaacc

SEQ ID NO: 336104 - DNA, 519 bp, Homo sapiens
  misc_feature: GZ8MTXP02ILIB6.4.34.D01.1.454.CMB.2.raw
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggcctcccaggctcctnatctatggtncatccaccagggccactggtactcccagccaggttccagtcgccaggtcgggtctggggacaggagttcactcacaccatcagcacgcctgacagtctagaagtatttgtacggtttattactgtcagtctagtatgtaataacgtggctgtactacgtttggccgtaaggggaccaaggctagggactatcgaaggcgaacgtggagtctgactac

SEQ ID NO: 336105 - DNA, 547 bp, Homo sapiens
  misc_feature: GZ8MTXP02JUSJM.4.34.D01.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagcaacttagcctggtacctgcagaacctggccaggctccaggctcctnatctatggtncatccaccgagggccacgtggtactcccagccaggttcagtcgccgaggtgggtctggggacaggtacgttcactctacaccatcagcacgcctgctagtctagtaagtagtttgtacggtttattacgtgtactagtctagtatagtacttaacgtggtacgttagtacgtacgtttcggaccgtacggggactaaggtcgtaggacgacgtacgaacggtacgacgtcgtacggctcgactacg

SEQ ID NO: 336106 - DNA, 519 bp, Homo sapiens
  misc_feature: GZ8MTXP02IF5XF.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggcctcccaggcctcctcatctatggtgcatccacagggccactggtactccccagccaggttcagtcgccaggtgggtctggggacagacgttcactctcaccatcagcagccctgcagtctagaagtagtttgtacggttttattacgtgttacagtctagtatgataacgtggcttagtactacgtttcggcgtaggggaccaaaggcgtagacgtatcgaaggcgaacgtggtgctgcac

SEQ ID NO: 336107 - DNA, 585 bp, Homo sapiens
  misc_feature: GZ8MTXP02IV652.4.34.D01.1.454.CMB.2.raw
  modified_base (307)..(307): a, c, t, g, unknown or other
  misc_feature (307)..(307): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgtagcagcaacttagcctggtacctgcagaaacctggccaggcctcccgaggtcctcctacatctatggtnccactccaaccgacgggcccacgtggtaactcccgaagcctacggttcagtcgccgtaggtcgggtcgtgggggacaggtacgttccacgttctacacctactcgagcacgcctgactagtctagaagttagtttgtacgtttaattacgtgttacgagtactaagtagtagtacttaacgtggtacttacgtacgttacgtttacggaccgacggggtaccaaaggtcgtacggacgtacgtacgaaggacgtaacgtcggtcgtacgtcgactacg

SEQ ID NO: 336108 - DNA, 558 bp, Homo sapiens
  misc_feature: GZ8MTXP02H5ECZ.4.34.D01.1.454.CMB.2.raw
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (465)..(465): a, c, t, g, unknown or other
  misc_feature (465)..(465): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtgcatcccaccgagggcccagtcggtactccccagcctacggttcagtcgccgtaggtcggggtctgggggacagtacgttccactctacacntcagcacgccctgcagttctagaagttnttttggacggttttattacgtgttcagtctagtatgaattaagnggtctagtacttacgtttcggacgtacggggacctaaggccgtagggactacgtacgaacgggcgtaaagtcggtacggtctcggacctaccg

SEQ ID NO: 336109 - DNA, 528 bp, Homo sapiens
  misc_feature: GZ8MTXP02IPWRZ.4.34.D01.1.454.CMB.2.raw
  modified_base (301)..(301): a, c, t, g, unknown or other
  misc_feature (301)..(301): n is a, c, g, or t
  modified_base (432)..(432): a, c, t, g, unknown or other
  misc_feature (432)..(432): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccgagggcccactggtactccccagcctaggttccagtcgccaggtcggggtctggggacagacgttcactctcaccatcagcacgcctgcagtctagtaagtatttgtcggtttattactgttnagtcagtatgtataacgtggtctagtactacgttttaggccgtaggggaccaagcgtaggagtatcgaaggacgaacgtcgtaggtctcgactacc

SEQ ID NO: 336110 - DNA, 537 bp, Homo sapiens
  misc_feature: GZ8MTXP02HH9Z5.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtgcatccaccagggccactggtactcccagccaggttcagtgccaggtcgggtctggggacagagttcactctcaccatcagcagcctgctagtctagtaagttatttgtacggtttattacgtgttcagtctaagtatagtataacgtggacttagtacttacgtttcggaccgtaggggaaccaaggcgtaggagtagtacgaaggtacgaacgtggtcggactcggactaaccg

SEQ ID NO: 336111 - DNA, 589 bp, Homo sapiens
  misc_feature: GZ8MTXP02H5ANY.4.34.D01.1.454.CMB.2.raw
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
tcagagcactgtagcacgaccggtgctcgatttagatcgtctgtgttgggtttgggggaagaggaagactgaccggtcccccaggagttcaggtgctgggcacggtgggcatgtgtgagttttgtcacaagatttgggctcaacttttcttgtccctaagactctcctgtgcagcctctggattcacctttagtacctatgccatgggctgggtccnccaggctccgtgggaaggcctggcgtgggtctcaggaattagtactagcggtggccatacatactacgcagattccgngaagggccattcaccatctccaggacaactccaaagacacgctgtatctgacaaaatcgaaacngcctgagagccgaggacacggtcctttattctgttacgaaacgtcccggggtggggggagttagttaatacgtgacctagttgacagatccgtgggccgacgggaacccgtggtaccaccgtctcctcacgtccaccaaccgaacgggcccaacgtccggtccctttccccgtcggcccacccctcctacccaacgacgccaccgtcgtcggggacacgacgccggcccg

SEQ ID NO: 336112 - DNA, 599 bp, Homo sapiens
  misc_feature: GZ8MTXP02ITRN8.4.34.D01.1.454.CMB.2.raw
  modified_base (467)..(467): a, c, t, g, unknown or other
  misc_feature (467)..(467): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgttggacaggaaccccttggtcttccggcgagcgggcttttcgacccgctttatccgttacttatgtcagcattcgcacttctgactacctcagcatcgcctcacagcacaccttcacagcttacagtaaccncctacccctaacccaacaaccgacactaacgcgtacgctcgccgctacgtcgttcggtcgtacgtacgttcggtttaccgtccccgtttactaaccgttcccgttacccgacctacttcctacgtaactacg

SEQ ID NO: 336113 - DNA, 598 bp, Homo sapiens
  misc_feature: GZ8MTXP02F8E9Z.4.34.D01.1.454.CMB.2.raw
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagccaccctctcctgcagggccagtcagagtgttagcagcaacttagcctggtacctgcagaaacctggccaggcctcccaggcctcctcatctatggtncactccacgagggccactggtactcccagcctaggttcagtcgccgtaggtcggggtctggggacaggtacgttcacttctcaccatcagcagcctgacngtctggtaaacgttagttttcggtacggttttaatttacgttgtaccgtagtacgtaagttaagtaggtaattaaacgtggtacttagttaacgtacgtttttacgggacccgtaagggggaaccctaaagggtccgtagggaacgtacgtacggaacggtacgtaaacgtggtacggctacggaccgtaaccg

SEQ ID NO: 336114 - DNA, 572 bp, Homo sapiens
  misc_feature: GZ8MTXP02GRXFG.4.34.D01.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccgaggcctcctnatctatggtncatccaccgagggccacgtggtactcccagcctaggttcagtcgccgtaggtcgggtctggggacaggtacgttccactctcaccatcacgcacgctgcagtctagtaagttagtttgtacggtttattactgtacagtacgtagtagtagtaattacgtggtacttacgtacgttacgttttcgggaccgtaggggaacccaaggtaccgtaggaacgtacgttacggaacggtaccgtaaacgtcggtaggtctacggactaacccg

SEQ ID NO: 336115 - DNA, 575 bp, Homo sapiens
  misc_feature: GZ8MTXP02FX2M3.4.34.D01.1.454.CMB.2.raw
  modified_base (315)..(315): a, c, t, g, unknown or other
  misc_feature (315)..(315): n is a, c, g, or t
  modified_base (431)..(431): a, c, t, g, unknown or other
  misc_feature (431)..(431): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtcctccaggccacctgtctgtgtctccgagggacagacgcccaccctctcctgcgagggccagtcagagttgtagcagactaacttcgccgtcggtacctgacaagaaacctggccaggcctcccgaggcctcctcatctagtggtncactcccgacgacgggccctacgtcggtacctcccgagccgtaggttcagtcgaccgtaggtcgggtcgtggggaccaggtacgttccactctaccactatcacgcacgcctgacncgtctagagttagtttgtacgtttatacgtgtacagtactagttatagtaatacgtgtcttagtacgttacgtttcggacgtaacgggaccaaggtcgtacggagtacgtacgaacggtacgtaacgtggtcgcgcgactaacg

SEQ ID NO: 336116 - DNA, 581 bp, Homo sapiens
  misc_feature: GZ8MTXP02JP1U4.4.34.D01.1.454.CMB.2.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgtagcagcaacttgcctggtacctgcagaaacctggccaggctccaggcctccncatctatggtncatccaccgagggcccagtggtactcccagccacggttcagtcgcaggtgggtctggggacaggagttcactctcacatcagcagcctgctagtctagtaagtatttggtacggtttattacgttgtccgtagactaagtataggtaattaacgtcggtacttaacgttacttacgtttttacggaccggtaacgggggaaccctaaaggtacgttacgggaacgtaacgtaccggaagggtaccgtaaaccgttaggtacggtaccgtcggacctaacccg

SEQ ID NO: 336117 - DNA, 571 bp, Homo sapiens
  misc_feature: GZ8MTXP02F4T2K.4.34.D01.1.454.CMB.2.raw
  modified_base (464)..(464): a, c, t, g, unknown or other
  misc_feature (464)..(464): n is a, c, g, or t
  modified_base (513)..(513): a, c, t, g, unknown or other
  misc_feature (513)..(513): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcacctgccccgattacgtggacaggaacccttggtcttccggcgagcgggtcttttcacccgctttatccgttacttatgtcagcattcgcacttctgactacctccagcatcgcctcacagcacaccttcacagcttacagaacncctaccccaccaacaacgcataacgcgtcgctcgccgcacgcttcggtnctattcggtttacgccccgtttacaacgttccttcccgcctactcctacgtactaacg

SEQ ID NO: 336118 - DNA, 586 bp, Homo sapiens
  misc_feature: GZ8MTXP02JL0OP.4.34.D01.1.454.CMB.2.raw
  modified_base (400)..(400): a, c, t, g, unknown or other
  misc_feature (400)..(400): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtgcatccaccagggccactggtactcccagccaaggttcagtcgccaggtggctggggacagagttcactctcacatcagcagcctgcagtctgaaagtntttgtacggtttattactgtacagtctaaggttataggtaacttaacgtcgggtacttacggttaacttacgtttttcggggacccgtaaacggggggtaacccaaagggtccgttagggggaacgtacgttaccgaaggggtaccgtaaacgttaggtacggtaacgttacggaccgtaaacccg

SEQ ID NO: 336119 - DNA, 590 bp, Homo sapiens
  misc_feature: GZ8MTXP02HJO3Q.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggcctcccaggcctccctcatctagtggtcgcactcccaccgacgggcccacgtcggtactccccgagcctaggttccagtcgccgtaggtcggggtctgggggacaggtacgttccacttcgtcaccatcacgcacgcctgctagtctaggtaagttagtttcggtacggtttattacgttgtacagtacgtaagttatagtaacttacgttggtacttacgttaacttacgttttacggaccggtacggggaaccgtaaggcgtaggacgtacgtacgaaggtacgtaacgtcggtcggcgtacgactaaccg

SEQ ID NO: 336120 - DNA, 600 bp, Homo sapiens
  misc_feature: GZ8MTXP02G9CRY.4.34.D01.1.454.CMB.2.raw
  modified_base (302)..(302): a, c, t, g, unknown or other
  misc_feature (302)..(302): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgttagcagcaacttgcctggtacctgcagaaacctggccaggctcccaggcctcctcatctatggtncactcccaccgacggggccctacgtcggtaactccccgagtccacgggtttcaggtcgccgtaggtcgggtctgggggaaccaggtacgttcaccgttctaccaccatcacgcacgcctgctacgtctagtaagttagtttgtacggtttattactgtacgagtacgtaagtagtagtaacttaacgtggtacgttacgttacttacggttttacggaccggtacggggtacccgtaaggtcggtaggaacgtagtacggaacggacggtaacgtggtacggtcctcggacctaaccg

SEQ ID NO: 336121 - DNA, 570 bp, Homo sapiens
  misc_feature: GZ8MTXP02IDQ5M.4.34.D01.1.454.CMB.2.raw
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (481)..(481): a, c, t, g, unknown or other
  misc_feature (481)..(481): n is a, c, g, or t
tcagagcactgtagcacgaccggtgctcgatttagatcgtctgtgttgggtttgggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttctccgtcccccttgcagtaacaccaagtacaggaatattaacctgttcccatcgactacgcctttcggcctcgccttagggtcgactcacctgccccgatacgtgacagaccctgtctcgcgagcggctttcaccgtntttatccgttattatgtcagcattcgctacttcngactacctccagccatcgcctnacagcaccacttcacagcttaaacacgaaacgcctaccccaacccaaacaaaccgcaanaacgcgtcgctcgccccgcacgtcgttacggcacgtacgttcggttaccgtcccttacaacgttccctacccgctactctacgactacg

SEQ ID NO: 336122 - DNA, 548 bp, Homo sapiens
  misc_feature: GZ8MTXP02HNC8P.4.34.D01.1.454.CMB.2.raw
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaacctggccaggctcccaggctcctnatctatggtgcatccaccagggccacgtggtactcccagccaggttcagtgccagtggtctggggacagagttccgactctcaccatcacgcagcctgcagtctagtaagtntttgtacgtttattacgtgtacagtcgtaagtagtgtaataacgtggtcttagtacttacgtttcggacccggtaggggaaccctaaggtcgtaggaacgtagtacgaaggtcgtaaacgttggacgtccgtacggaccctaaccg

SEQ ID NO: 336123 - DNA, 548 bp, Homo sapiens
  misc_feature: GZ8MTXP02JE757.4.34.D01.1.454.CMB.2.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtacagagtgttagcagcaacttagcctggtacctgcagaaacctggccaggctccccaggcctcctnatctatggtncatccacagggccacgtggtactcccagccaggttcagtgccagtgggtctggggacaggtagtcactctccacatcagcacgcctgccagtctagtaagtagtttggtacggtttattacgttgtcgtagactagtagtgtaattaacgtggtactagttacgtacgttttcggaccgtaaggggaccgaaggtaccgtacggaagactacgaaggcgtaacgtggtcggcgtcgactaaccg

SEQ ID NO: 336124 - DNA, 525 bp, Homo sapiens
  misc_feature: GZ8MTXP02JXQPW.4.34.D01.1.454.CMB.2.raw
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtncatccaccagggcccacgtggtactcccagccaggttccagtgccaggtgggtctggggacaggagttcactctcaccatcagcagcctgcagtctagaagtagtttgtcggtttattactgtcagtcagtatagtataacgtggacttgtactacgttttcggaccgtaggggaacctaaggacgtacggagagtcgaaggcgaacgtgtagctcgactaccg

SEQ ID NO: 336125 - DNA, 654 bp, Homo sapiens
  misc_feature: GZ8MTXP02IV1M8.4.34.D01.1.454.CMB.2.raw
  modified_base (217)..(217): a, c, t, g, unknown or other
  misc_feature (217)..(217): n is a, c, g, or t
tcagagcactgtagcacgaccggtgctcgatttagatcgtctgtgttgggtttggggggaagaggaagactgacggtccccccaggagttcaggtgctgggcacggtgggcatgtgtgagttttgtcacaagatttgggctcaactttcttgtccctaagactctcctgtgcagcctctggattcacctttagtacctatgccatgggctgggtccnccaggctccgtgggaaggcctggcgtgggtctcgaggaattagtactaggcggtggccatacatactacgcagatccgtgaaggccatcaccatctcaggacaactcaaagaacacgctgtatctgacaaatgaacagcctagagacgcgaggacaacggtccgtttatttcctggtagacgtaaacgttcccgggggtagggggggtattaagttagtacgtgccgtagttgacagtaacgtccggtagggggaccgaacggggtaacccgtgggtaccgtaaccggtcctacccgttctaacggtcccctaacccgaacccgaaacggggtccccaaacgttcccgggttcccttcccccgttcggccctaccccgtacccaaccgaaacgaaccggccaaccggttcgtcgggggaccaacgacggccccgggg

SEQ ID NO: 336126 - DNA, 514 bp, Homo sapiens
  misc_feature: GZ8MTXP02JW810.4.34.D01.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (418)..(418): a, c, t, g, unknown or other
  misc_feature (418)..(418): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccccgtctgtgtctccaggggacagagccaccctctcctgcagggccagtcagagtgttagcagcaacttagcctggtacctgcagaaacctggccaggctcccaggctcctnatctatggtncatccacagggccagtggtacncccagccaggttccagtgccagtggtctgggcagagttcactctcaccatccagcagctgcagtctgaagtatttgtcgtttattactagtcagntagtatagtataacgtagtcgtagtactacgtttacgtccgacgggaccgaacgacgtcggacgagtacgaggaacgacgtacgtggcgcgcacac

SEQ ID NO: 336127 - DNA, 620 bp, Homo sapiens
  misc_feature: GZ8MTXP02IOSBY.4.34.D01.1.454.CMB.2.raw
  modified_base (311)..(311): a, c, t, g, unknown or other
  misc_feature (311)..(311): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcgagggccagtcagagtgttagcagctaacttagcctggtacctgacagaaacctggccaggcctcccgaggcctcctcatctagtggtcncactcccaccgacgggcctacgtcggtacctcccagccgtaggttccagtcgaccgtagggttcggggtcgtgggggactaggtacgttaccaccttctaccaacctactcgacgcacgcctcgacgtacgtacgtacgtaagttagtttcggttacggttttaatttacgtcgttacgtagtacgtaagtagtagtaagttacgtggtacttacgtacttacggtttacggacggtaacggggaccgtaaaggtcggtaggacgtacgtacggaaggacgtaacggtcggtaggtcgtacgactaccg

SEQ ID NO: 336128 - DNA, 527 bp, Homo sapiens
  misc_feature: GZ8MTXP02F47NO.4.34.D01.1.454.CMB.2.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgcagaaacctggccaggctcccaggctccnatctatggncactccaccagggccacgtcggactcccagcctaggttcagtgcctaggtcgggtctggggacaggtacgttccacgtctacacatcagcagcctgcagtctagtaagtatttggtacggttttatacgtgttacagtactaagtatagtaataacgtggctagtactacgtttcgacgtaggacagctaggacacgtagaaggtcgaacgtgacgctcgactac

SEQ ID NO: 336129 - DNA, 489 bp, Homo sapiens
  misc_feature: GZ8MTXP02FI84Y.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagcaggttcagtgccagtgggtctggggacagagttcactctcaccatcagcagcctgcagtctgaagtatttgcggtttatactgtcagcagtatgataactggctgtacactttggccaggggaccaagctggagatcgaaggcgaactggtaggctgcac

SEQ ID NO: 336130 - DNA, 555 bp, Homo sapiens
  misc_feature: GZ8MTXP02H3970.4.34.D01.1.454.CMB.2.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
tcagagcactgtagcacgaccggtgctcgatttagatcgtctgtggttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccagggggacagagccaccctctcctgcagggccagtcagagtgttagcagcaacttagcctggacctgcagaaaccgngcagcncngcncnatntngngnancacagcacngtactcacgcacgtnagngcgngtggtcgtggagagagtctactctacacacacagacacgccncgacagtacgtagtaagtagtttagttacgtttagtttacgttagtacgtagacgtagtagtagtaagtaaacgtacggtacgttagtacgttaacgtttacggtacggtaacgggaaaccggaaacgtacgtacggacggtacgtacgaacggacggaacgtacggtaggtcgtacgaccgaccg

SEQ ID NO: 336131 - DNA, 563 bp, Homo sapiens
  misc_feature: GZ8MTXP02IMZGG.4.34.D01.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgttagcagcaacttgcctggtacctgcagaaacctggccaggctccgagcctccnatctatggtncactccaccgagggcccagtcggtactccccagcctaggttcagtcgccgtaggtcgggtctggggacagtacgttcactcacacatcagcacgcctgctagtcgtagtaaagttagtttagtacggttttaattacgttagttcagtactagtatagtaactaacgtgtacgttagtactacgttttacggaccggtacggggaaccaaggtacgtaggacgagtacgaaggtacgtaacgtcggtcgtcgtcgacgtaccg

SEQ ID NO: 336132 - DNA, 618 bp, Homo sapiens
  misc_feature: GZ8MTXP02JP8HH.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccaggggacagacgccaccctctcctgcagggccagtcagagtgttagcagcaacttagcctggtacctgcagaacctggccaggcctccaggcctcctcatctagtggtgcactccgaaccgacgggcctacgtggtacctccccgagcctacggttcaggttcgccgtaggtcgggtcgtgggggactaggtacgtttccaccgttctaccaacactccacgcacgtccctgcgtacgtactagtaagttacgttttacggttacggtttaattacgtcgtacgtagtacgtaagttagtagtaattaacgtcgtacgttacgtacgttacgtttacgggaccgtaggggaaccgtaacgtcggtacggagtaacgtacggaacggaccgtaacggtcggtacggtaccgtacgaccgtaacg

SEQ ID NO: 336133 - DNA, 554 bp, Homo sapiens
  misc_feature: GZ8MTXP02GJZ6P.4.34.D01.1.454.CMB.2.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
  modified_base (523)..(523): a, c, t, g, unknown or other
  misc_feature (523)..(523): n is a, c, g, or t
  modified_base (544)..(544): a, c, t, g, unknown or other
  misc_feature (544)..(544): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcagggccagtcagagtgttagcagcaacttgcctggtacctgcagaaacctggcaggctccagctcncatctatggtncactccacagggccacgtgactccagccaggttcagtcaccgtaggtcgggtctgggggacaaggtacggtttaccaccttctaccaacctatcagccacgctgacngttcagtaagtagtttgttacggtttattacttaggttcacggtatagtaatagtaattaacgtggtactagttacttacgtttcggaccgtaaggggaccaaagtcgtaggaagntacgaaggtacgaacgtcggngcacgacacg

SEQ ID NO: 336134 - DNA, 597 bp, Homo sapiens
  misc_feature: GZ8MTXP02IB8SP.4.34.D01.1.454.CMB.2.raw
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
  modified_base (510)..(510): a, c, t, g, unknown or other
  misc_feature (510)..(510): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggattttgcctaggaaaaccagcctacacgacttaaaccgggacaaccgtcgcccggccaacatagccttctccgtccccccttcgcagtaacaccaagtacaggaatattaacctgtttcccatcgactacgcctttcggcctcgccttaggggtcactcaccctgccccattaacgttgacaggaacccttggtcttccggcgagcgggtctttcgaccgtcttactccgttactatgtcagctnttcgctacttctgactacctcagcancgcctcacancaccaccttcgacagcttacacgaaccncctcccctaacccaacaaccgcaataacgccgtcgccncgcgcgacgtcgttcgtcgtcgtacgttacgttaccgttcccgttcctaaccgttcccgttacccgtacctactactacgtactacg

SEQ ID NO: 336135 - DNA, 560 bp, Homo sapiens
  misc_feature: GZ8MTXP02GIPUH.4.34.D01.1.454.CMB.2.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (406)..(406): a, c, t, g, unknown or other
  misc_feature (406)..(406): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagccaccctctcctgcagggccagtcagagtgtagcagcaacttagcctggtacctgcagaaacctggccaggcctccccaggcctcctnatctatggtncactcccaccgagggccacgtggtactcccagcctaggtcagtcgccgaggtcgggtctggggactaggacgttccacgtctaccaccatcagcagcctgcngtctagaatagtttgtacgtttattacgtgtcaggctaagtatgaattacgtggtctagtacgttacgtttcgggaccgtaggggaacccaaggtcgtagggaacgtagtacggaaggtaccgtaaacgtggtacgggtctacggacctaaccg

SEQ ID NO: 336136 - DNA, 595 bp, Homo sapiens
  misc_feature: GZ8MTXP02IFH8B.4.34.D01.1.454.CMB.2.raw
  modified_base (303)..(303): a, c, t, g, unknown or other
  misc_feature (303)..(303): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctccccaggcctcctcatctatggtncatcccacacgggccactggtactcccagccaggttcagtgccagtgggtctggggacagtagttccactctcaccatcagcagccctgctagtctagtaagtattttggtacggttttaattaccgttggttacaggtactaagttattaggtaattaaacgtgggttaccttaggttaacctacgtttttcgggacccgtacgggggaaccctaaaggccgttagggaacgtagttacccggaaaggggtacccgtaaacggtggttcgggccttacggcccgtaaaccc

SEQ ID NO: 336137 - DNA, 523 bp, Homo sapiens
  misc_feature: GZ8MTXP02HR773.4.34.D01.1.454.CMB.2.raw
  modified_base (291)..(291): a, c, t, g, unknown or other
  misc_feature (291)..(291): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagcccaccctctcctgcagggccagtcagagtgttagcagcaacttagcctggtacctgcagaaacctggccaggcctccaggctccncatctatggtgcatccaccgagggcccagtggtactccccagccaggttcagtgccaggtcgggtctggggacaggtacgttccactctcaccatcacgcacgcctgcagtctagaagtgtttgtcgtttattactgttcagcagtatgatactggtctgtactacgtttcgaccgtaggggaccaagtcgtaggagacgtcgaaggacgtaacgtcggtgcgtacgctaac

SEQ ID NO: 336138 - DNA, 609 bp, Homo sapiens
  misc_feature: GZ8MTXP02GMZQ4.4.34.D01.1.454.CMB.2.raw
  modified_base (307)..(307): a, c, t, g, unknown or other
  misc_feature (307)..(307): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgacagaaacctggccaggcctcccaggcctcctcatctatggtncactccacgacgggccacgtggtactccgagccaggttcagtcgccgtaggtcggtcgtggggactaggtacgttcacctctacaccatcagcacgcctgctagtctagtaagttacgtttggttacggttttattacgttgttacgagtactagttagtagtagttaacgtggtacttacgttacgttacggttttacggacccggtaaacggggaacctaaaggtccggttagggaaacgtacgttaacggaacggtaccggtaaacgttcggggtacgtcgttaacggccgttaaaccg

SEQ ID NO: 336139 - DNA, 595 bp, Homo sapiens
  misc_feature: GZ8MTXP02I7E2X.4.34.D01.1.454.CMB.2.raw
  modified_base (494)..(494): a, c, t, g, unknown or other
  misc_feature (494)..(494): n is a, c, g, or t
tcagagcactgtagcacgaccggtgctcgatttagatcgtctgtgttgggtttggggggaagaggaagactgacggtcccccaggagttcaggtgctgggcacggtgggcatgtgtgagttttgtcacaagatttgggctcaacttttcttgtccctaagactctcctgtgcagcctctggattcacctttagtacctatgccatgggctgggtccgcaggctcctgggaaggcctggcgtgggtctcaggattagtactagcggtggccatacatactacgcagattccgtgaagggccgattcaccatctccaggacaactccaaagaacacgctgtatctgacaaatcgaacagcctgagagccgaggacacggtccgtttattctgtgacgaaagtcccggggtagggggggtagttagttagtacgtgccgtagttgcgagaacgtccgtggggccgacgggaacccgtggtccgaccgtcctccgtcncgcctccaccgaacggcccacgtccggtcccttcccccgtcggcccacccctccctacccgaaacgcgccacccgtcgtcgggggaccacgacggcccggg

SEQ ID NO: 336140 - DNA, 600 bp, Homo sapiens
  misc_feature: GZ8MTXP02GZ4EC.4.34.D01.1.454.CMB.2.raw
  modified_base (306)..(306): a, c, t, g, unknown or other
  misc_feature (306)..(306): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgtagcagcaactagcctggtacctgcagaaacctggccaggcctcccgaggcctcctcatctagtggtncactcccacgacgggccacgtcggtactcccgagtccaggttcagtcgccgaggtcggtcgtggggacaggtacgttccactctaccgacactcgacgcacgtcctgcacgtcgtagtaagttagtttcgtacgtttattacgtgtacgagtacgtagttacgtagtataacgtggtaccttagtacgttacggtttacggaccggtaacggggaacccgtaaggtaccgttagggaacgtacgttacggaacggtacggtaaccgttggtcggtaccgtacggtacctaaccg

SEQ ID NO: 336141 - DNA, 631 bp, Homo sapiens
  misc_feature: GZ8MTXP02JX767.4.34.D01.1.454.CMB.2.raw
tcagagcactgtagcacgaccggtgctcgatttagatcgtctgtgttgggtttgggggaagaggaagactgacggtccccccaggagttcaggtgctgggcacggtgggcatgtgtgagttttgtcacaagatttgggctcaactttcttgtccctaagactctcctgtgcagcctctggattcacctttagtacctatgccatgggctggtccgccaggctccgtgggaagggcctggcgtgggtctcaggaattagtactagcggtggccatacatactacgcagattccgtgaaggccgatcacatctccaggacaactcaagaacacgctgtatctgacaaatcgaacagcctagagagccgaggacacggtccgtttattcgtgtgacgaacgtcccgggtaggggggtagttagttagtacgtgccgtagttcgacagtaacgtccggtacggggccgaacggggacccgtgggtccgtacccgtccgtccctaccgacgcccctacccgaccgaacgggacccctaccgttcccggttcccttccccccgtcggcccctaccccctcccgtacccgaaccgaacgcccgacccgtccgtcgggggacccaccgacggccccggg

SEQ ID NO: 336142 - DNA, 548 bp, Homo sapiens
  misc_feature: GZ8MTXP02H1YQU.4.34.D01.1.454.CMB.2.raw
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgttagcagcaacttagcctggtacctgcagaaacctggccaggctccaggctcctcatctagtggtcncactcccaccgagggccctaacgtggtaactccccagcctaggttcagtcgcctaggtcggggtctgggggacaggtacgttccactctacaaccntcagcagccctgctagtctagaagtntttgacgttttattactgtcagctagtatgaattaacgtggtcttagtacttacgtttcgggaccgtaagggggaacctaaggctagggacagtcgaaggcgaacgtggtggacctgaccacg

SEQ ID NO: 336143 - DNA, 617 bp, Homo sapiens
  misc_feature: GZ8MTXP02HCZJZ.4.34.D01.1.454.CMB.2.raw
  modified_base (215)..(215): a, c, t, g, unknown or other
  misc_feature (215)..(215): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctcncctgcagggccagtcagagtgttagcagcaacttagcctggtacctgacagaacctggccaggctccaggctcctcatctatggtcacactcccacgacgggccacgtggtactcccagcctaaggttcagtgaccgtaggtcgggtctggggacaggtacgttcacgttctacaccagtcaacgcacgcctgctacgtcgtagtaagttagtttcgtacggttttattacgttcgttacgagtctaaggttatagtaacgttaaccgtgggtactttacgggttacttaaccggttttacgggaacccggttaacgggggaacctaaacggtccgttacgggaaaagtccgtaaggtaacggaccggtaaacgttcgggacggtacctcggtactaacccg

SEQ ID NO: 336144 - DNA, 656 bp, Homo sapiens
  misc_feature: GZ8MTXP02JLZ9E.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggccaccctgtctgtgtctccgaggggacagacgccaccctctcctgcgagggccagtcagagtgtagcagcaactcgcctggtacctgacagaaacctggaccacggcctcccgaggtcctccctctactcgtatcggtcgactactccaaccgacgggcctacgtcggtactcccgacgaccgtaggtcaggtcgaccgtaggtcggggtgtcgggggaactaggtaccgttaccacgttacctacctaacccagtaccgacgaccgacgcccgttgacgtacgttacgttaaggtaaagtttacgttttacggttaccggtttttaattacgtcggttagaacgtacgtaagttaagtcgtaaacgttagtcggtacgtttagtacgttaacggtttcggaccggtaacggggaacctaaggcgtaggacgtacgtacggaacggaccgtaggttacgacggtcctacgacctaaccg

SEQ ID NO: 336145 - DNA, 546 bp, Homo sapiens
  misc_feature: GZ8MTXP02G1JNU.4.34.D01.1.454.CMB.2.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctccncatctatggtncatcccaccgagggcccacgtggtaactccccgagccgtacggttcagtcgcccgtaggttcggggttctgggggaccaggtacgttccactctcaccatcagcacgcctgctagtctagtaagtagtttcgtacggtttattactgtcagtctagtatgtatacgtggtctagtactacgtttcggaccgtagggaccaagcgtaggacgagtcgaaggtacgaacgtgtaggctcgacaccg

SEQ ID NO: 336146 - DNA, 546 bp, Homo sapiens
  misc_feature: GZ8MTXP02F2EH5.4.34.D01.1.454.CMB.2.raw
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccacctctcctgcagggccagtcagagtgttagcagcaacttagcctggtacctgcagaaacctggccaggctcccaggctcctcatctatggtgcatcccaccgacgggccactggtaactcccagccaggttcagtgccagtcgggtctggggacngtagttccactcgtcaccatcagcacgcctgcagtcngaatactttgcggttttatactgtcagctagtatgatactaggctagtactagtttcggacccgtaggggtaaccaaggcgttagggacgagttaccggaagggtacgtaaaaccggtttggacgggtcttacggtactaaacccg

SEQ ID NO: 336147 - DNA, 576 bp, Homo sapiens
  misc_feature: GZ8MTXP02ILPHM.4.34.D01.1.454.CMB.2.raw
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccagggggacagacgccaccctctcctgcagggccagtcagagtgttagcagcaacttagcctggtacctgcagaaacctggccaggctccccgaggcctccctnatctatggtcncatcccaccgagggccacgtggtactccccagccctaggttccagtcgccgaggtcgggtctgggggacaggtacgttccactctacaccatcagcacgcctgctacgtctagtaagttagtttgtacggttttattacgttgtactagtacgtagtagtagtaattacgtggtcttagtactacgttttcggaccggtaacggggacctaaaggtcgtaggacgtacgtacgaaggtacgtaacgtcggtgtcgtacgacgtaaccg

SEQ ID NO: 336148 - DNA, 570 bp, Homo sapiens
  misc_feature: GZ8MTXP02JM3YX.4.34.D01.1.454.CMB.2.raw
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgttagcagcaacttagcctggtacctgcagaacctggccaggctcccaggctcctcatctatggtncatccaccagggccagtggtactcccagcctaggttcagtcgccgtagtgggctggggacaggtagttccactctacacatcagcagcctgcagtctagaagttattttgtacggttttattacgttgttacagtactaagttatagtaattaacgtggacttagtacttacgttttcgggaccgtaacgggggaacctaaggtaccggtagggaacgtacgttacgaacgggtccgtaaacggtggtcggtacgttacggactaaccg

SEQ ID NO: 336149 - DNA, 575 bp, Homo sapiens
  misc_feature: GZ8MTXP02IXL0Q.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagccaccctctcctgcagggccagtcagagtgttagcagctaacttagcctggtacctgacagaaacctggccaggcctcccaggcctcctcatctatggtgcactccaccgacgggccacgtggtactcccgagccaggttcagtcgccgtaggtcggggtctggggacagtacgttccacgtcctcaaccctatacagccacgcctgactacgtcgtagtaagttagtttacggttacggttttaattacgttgttactacgtactaagtagtgtaataacgtggtacttacgtacttacgtttcggaccgaaggggacctaaagcgtaggacgagtcgaaggacgtacgtggtcggctacgactaccg

SEQ ID NO: 336150 - DNA, 621 bp, Homo sapiens
  misc_feature: GZ8MTXP02JISKY.4.34.D01.1.454.CMB.2.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgcccaccctctcctgcagggccagtcagagtgtagcagcaacttgcctggtacctgacagaaccnggccaggcctcccgaggtcctcctcatctatggtncactccgaccgacgggcctacgtcggtaacctccccgaggtcctacggttcacggttcgccgtagggtcggtcgtggggacaggtacgttccactctaccaccatcacgtcacgctgctagtctagtaagttacgtttggtacgtttattacgtgtacagtacgtagttagtagtaactaacgtcggtacttacgttacgttacggtttacgggaccggtaacggggaaccctaaggtaccggttacgggaagtaccgttaacggaacggtacggttaaacgtcggggtaacggtccgtaccggtaccctaacccg

SEQ ID NO: 336151 - DNA, 730 bp, Homo sapiens
  misc_feature: GZ8MTXP02I3FBO.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacaggacgcccacccctctcctgcgacgggccagtcaggtagttggttagcagactaacgttacgcccgttaggtacctgaccgaaacggtaaacccgtcgggacccgaacggtcccctaccccggagggtccccttccctctacttaccgttagtcgggtcgactaccgtccccgaacccggacgggccctacggttacggtacctccccgaagtcccgtaggttacaggtcgaccgtaggggttcgggtcgtagggggacctaaggtacgttccaccgttactaccgacctactcgacgaccgacgtcccgtagaccgtagttacgtacggttaaagtttacgtttcggttacgggttttaactttactcggttactacgtacggtaattacgtagttaacgttacggtcgggttacttacgttaaccgttcggtttacggaccggtaacggggaaaccgtacggtacggttaggacggtagtacggaacgggtacgtaacggttggcggtacgtacggtacctaacg

SEQ ID NO: 336152 - DNA, 642 bp, Homo sapiens
  misc_feature: GZ8MTXP02JEVAM.4.34.D01.1.454.CMB.2.raw
  modified_base (443)..(443): a, c, t, g, unknown or other
  misc_feature (443)..(443): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgttcccatcgactacgccttcggcctcgccttaggggtcactcaccctgccccgattacgtgacaggaacccttggtcttccggcgagcgggtcctttcgacccgtacgtttactccgttacttagtgtccagcctattcgctacttctgactacctccagccagtccncctacacacgaccacctaccttacaacgtacgtacttaacgacgaaccgtcccctaccccgtaacccaacgaaccgactaacgtacgtcgtccgcgtcgccgcgtacgtccgttcggtcgtacgttacggttccggtttacccgttccccgttactaaccgttcccgttacccgtacctacttccgtacgtaccgtacg

SEQ ID NO: 336153 - DNA, 632 bp, Homo sapiens
  misc_feature: GZ8MTXP02HABOO.4.34.D01.1.454.CMB.2.raw
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgacgggccagtcagtagtgttagcagcaacttagcctggtacctgacagaaacctggccaggcctcccgaggcctcctnatctagtggtncactccaccgacgggcctacgtcggtaactcccgacgtcctacggttcaggtcgccgtagggttcgggtcgtgggggacctaggtacgttcaccgttcaccacctatcgaacgcacgcctagactacgttacgtaggtaagtttagttttacggttaacggttttacttacgttggtactaggtacttaaaggtataggtaacttaacggttcggtactttacgttaacgttacggtttacggaccggtaacggggaacctaaaggtccgtaggaacgtacgtacggaacggtacgtacgtggtacgtcgcgacctacg

SEQ ID NO: 336154 - DNA, 622 bp, Homo sapiens
  misc_feature: GZ8MTXP02IY6KN.4.34.D01.1.454.CMB.2.raw
  modified_base (295)..(295): a, c, t, g, unknown or other
  misc_feature (295)..(295): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgttagcagcaacttgcctggtacctgacaagaaacctggccaggcctccgaggcctcctnatctagtggtgacactccacgacgggccacgtggtactcccgagccgtacggtacagtcgccggtaggtcggggtcgtcggggactaggtacgttccactctacactatcagcacgcctgctacgtcgtagtaagttagtttcgttacggtttaactttcgtacgtacgacgttagtaagttagtagtaaacttaacgtcggtacgtttagtaaccgttacggttttacgggaccggtaaacgggggaccaagggtaccgtaggggtaaccagttaccggaaacgggtacgaaaacggttgggacggtaccgtcgaaccggtaaccg

SEQ ID NO: 336155 - DNA, 641 bp, Homo sapiens
  misc_feature: GZ8MTXP02IEL5B.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgagggggacagacgccaccctctcctgcgagggccagtcagagtgttagcagcaacttagcctggtacctgacaagaaacctggccaggcctcccgaggcctcctcatctagtcggtgcactcccgaccgacgggccacgtcggtactcccagccgtacggttcagtcgccgtaggtcggggtctgggggacaggtacgtttccaccgtctaccacctactcacgcacgccgtagctacgtcgttagtaagtttacgtttaggttacggttttacgtttacgttcgttacgtagtacgtaagttagtagtaacgtaacgttcggtacgttacgttacgttacggttttacgggaccggtaacgggggtaacctaaacgggtacgttagggacgtaacgtacggaacgggtacggtaacggttggtcggtacgttacggacctaaccg

SEQ ID NO: 336156 - DNA, 622 bp, Homo sapiens
  misc_feature: GZ8MTXP02IIYAX.4.34.D01.1.454.CMB.2.raw
  modified_base (298)..(298): a, c, t, g, unknown or other
  misc_feature (298)..(298): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggccaccctgtctgtgtctccgaggggacagacgcccaccctctcctgcagggccagtcagagtgttagcagcaacttagcctggtacctgacacgaacctggaccaggcctccaggctcctnatctagtggtcacactcccacgacgggccctagtcggtacctccgagcctaggttccagtcgccgtaggttcgggtcgtggggaactaggtacgttccaccttcaccacactcacgcacgtcctgactacgtcgtaagtaagttagtttacggttacgtttttacttacgttgttacgagtacgtaagttagtagtaacttacgtgttacgttacgttaacttacggtttacggaccggtacggggtaaacctaacggtcgtaaggacgtaacgtacggaacgggtacgtaacggttcggtacggtcctacggtaccgtaaccg

SEQ ID NO: 336157 - DNA, 533 bp, Homo sapiens
  misc_feature: GZ8MTXP02IHSES.4.34.D01.1.454.CMB.2.raw
  modified_base (430)..(430): a, c, t, g, unknown or other
  misc_feature (430)..(430): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtgcatccaccaggggccacgtcggtactcccagccacggttcagtcgccaggtcgggtctggggacagtacgttcactctcaccatcagcagcctgcagtctgtaagtagtttgtacggtttatactgtnagctaagtatagataacgtggtcttagtactacgtttcggacgacgggtacaaacggtcgtcggagatacgaaggacgaacgtggtcggacgtcgacgtaccg

SEQ ID NO: 336158 - DNA, 639 bp, Homo sapiens
  misc_feature: GZ8MTXP02FSYKA.4.34.D01.1.454.CMB.2.raw
  modified_base (306)..(306): a, c, t, g, unknown or other
  misc_feature (306)..(306): n is a, c, g, or t
tcagagcactgtagcacgaccggtgctcgatttagatcgtctgtgttgggtttgggggaggaactgctcagttaggacccagacggaaccatggaagccccagcgcagtttctcttcctcctgctactctggctcccagaaaccactggagaaatagtgatgacgcagtctccaggcaccctgtctgtgtctccaggggacagacgccaccctctcctgcagggccagtcagagtgttagcagcaacttagcctggtacctgcagaaacctggccaggcctcccaggcctcctcatctatcgggtnctactccaccgacgggccactggtactcccgagtaccgtaggttcccaggtcgaccgtaggtcggggtcgtaggggacacgtagttcctaccttcctaccaccctatacccgagaccacgcctacggactagtcctaaggtaacgttagttttacgtcggttttaaacttacgttagtacgtagtactaaggttatacgtaaactaacggtcgtacgttacgtaaccgtttacgtttacgggaccggtaacgggggaacctaaagggcgttaaggacggtaacgtacggacgggaacgtaacggttggtacgcgttacggcctaaccgttacg

SEQ ID NO: 336159 - DNA, 538 bp, Homo sapiens
  misc_feature: GZ8MTXP02GJC5D.4.34.D01.1.454.CMB.2.raw
  modified_base (302)..(302): a, c, t, g, unknown or other
  misc_feature (302)..(302): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggcctcctcatctatggtncatccaccagggccactggtactcccagccaggttccagtcgccaggtcggggtctggggacaggtagttcactctcacccatcagcagcctgcagtctagtaagtatttgtacggtttatactgtcagctagtatgataacgtgtctgtactacgtttcggaccgtaggggacccaaaggtcgtagggacgtatacgaaggaccgtaaacgtggtacgggcttcggactaacccg

SEQ ID NO: 336160 - DNA, 616 bp, Homo sapiens
  misc_feature: GZ8MTXP02JAX2C.4.34.D01.1.454.CMB.2.raw
  modified_base (287)..(288): a, c, t, g, unknown or other
  misc_feature (287)..(288): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgtagcagcaactgctggtacctgcagaactggccagcctccaggctcctnntctagtggtgcactccgaccgacgggcctactggtacctccagcctacggtcagtcgccgaggtcgggtcgtggggactaggtacgtttaccaccttccacaacctactcgaacgcacgccctgactgtactagtaagttagtttggtacggtttattacgtacgtcgaacgtgtaagttagtagtaacgttacgtggtacgttacgttaacgttaccggttttacgggaccggtaaacgggggaacctaagggtccggttaagggacgttacgaacggtaacgggtaaccgtaacgttgggtacggtcgttaccggaccgttaaccg

SEQ ID NO: 336161 - DNA, 586 bp, Homo sapiens
  misc_feature: GZ8MTXP02G1ZT4.4.34.D01.1.454.CMB.2.raw
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (484)..(484): a, c, t, g, unknown or other
  misc_feature (484)..(484): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaaccgggacaaccgtcgcccggccaaacatagccttctccgtccccccttgcagtaacaccaagtacaggaatattaacctgttccatcgactacgcctttcggcctcgccttagggcactcacctgccccgatacgtgacagaccctgctcggcgagcggtctttcaccgtctttancgttactangtcagcattcgctacttcngactacctccagcatcgcctcacagcacaccttacacaggcttaacacgaaacgcccttaccccaacccaaacaacgaccaanaaacgcgtcgctcgccgcacgtccttcggtcgcctaagttcggtttaaccgcccccgttttcaacttcccgtaccccgtctaactcctacgtaacctaaccg

SEQ ID NO: 336162 - DNA, 620 bp, Homo sapiens
  misc_feature: GZ8MTXP02I4IVU.4.34.D01.1.454.CMB.2.raw
  modified_base (294)..(294): a, c, t, g, unknown or other
  misc_feature (294)..(294): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagcaacttagcctggtacctgcaagaaaccgtgccaggcctcccaggctccnatctatggtgcatccaccgagggcccactggtacctcccgaggtcctacggttcagtcgccgaggtgggtctggggaccaggtacgtttcacgttccaccacctactcgacgacacgcctcgacgacgtctagtaagttacgttttggtacggttttatacgttcgtacagtactaagtagttagtaacttaacgtggtaccgttacgttaacgttacggttttacgggcccggtaaaccgggggtaacgtaacggtacggtaacggtacggaacgttacggaacggtacggtaaaccgttggtacggtcgttacggacctaaccg

SEQ ID NO: 336163 - DNA, 575 bp, Homo sapiens
  misc_feature: GZ8MTXP02JRQTU.4.34.D01.1.454.CMB.2.raw
  modified_base (429)..(429): a, c, t, g, unknown or other
  misc_feature (429)..(429): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagtagtgttagcagcaacttagcctggtacctgacaagaacctggccaggcctcccgaggtcctcctcatctagtggtcgcactcccgaccgacgggcctacgtggtactcccgagcctacggttcagtcgccgtaggtcgggtctggggacagtcgttcactctacacatcagcacgctgcagtactagtaagttntttaggttacgtttattacgtgtacagtactagtatagtactaacgtggtacttagttactacggtttcggaccggtaggggaacccaaggtcgtacggagtaacgtacggaacggtacgtaacgtggtacggcgtacggactacg

SEQ ID NO: 336164 - DNA, 583 bp, Homo sapiens
  misc_feature: GZ8MTXP02F2GE8.4.34.D01.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggccaccctgtctgtgtctccgaggggacagacgcccaccctctcctgcagggccagtcagagtgtagcagcaacttgcctggtacctgacagaaacctggccaggctccaggcctccnatctatggtncatccaccgagggccacgtggtactccagtccgaggttcagtcgaccgtaggtcgggtcgtgggggacaggtacgttaccacgttctacaccataccagccacgtcctgacgagtcgtagtaagttatttgttacggtttattacgtagttacagtactaagttaagtagtaagttaacgtcggtacttagttacgttacgtttacggaccgtaacggggaccaaaggtcgtagggacacgtacgaaggtaccgtaagtcggtacggctacgacctaacg

SEQ ID NO: 336165 - DNA, 631 bp, Homo sapiens
  misc_feature: GZ8MTXP02I0WR4.4.34.D01.1.454.CMB.2.raw
  modified_base (307)..(307): a, c, t, g, unknown or other
  misc_feature (307)..(307): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggcctcccagaaaccactggagaaatagtgatgacgcagtctccaggcaccctgtctgtgtctccgaggggacagacgccaccctctcctgcagggccagtcagagttgttagcagcaacttagcctggtacctgcagaaaccgtggccaggctccccaggcctcctcatctatggtncactccaccgagggcccacgttggtactccccagtcctagggttccaggtcgacccgtaggttcggggtacgtgggggaaccagggtaacgtttccacgttctactaccagtcagcacgcctgcaggttctagtaagtagttttgtacggttttattaacttgtactacgtacgtaagtagtagtaagttaacgtggtacttacgtacgttaccgttttacgggaccggtaaacgggggtaaccgtaaacggtcggtacgggtaacgtacgttacggaacggtaaccggtaacgttcggtaggtccgttacggaccgtaacccg

SEQ ID NO: 336166 - DNA, 691 bp, Homo sapiens
  misc_feature: GZ8MTXP02G4N99.4.34.D01.1.454.CMB.2.raw
  modified_base (304)..(304): a, c, t, g, unknown or other
  misc_feature (304)..(304): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcgagggccagtcagtagtgttagcagctaacttagcctggtacctgacaagaacctggaccacggcctcccgaggtcctccctntactcttagtggtcacctactcccgaaccgacggggccctagtcggtaactccccgaaggccgtacggttccgagttcggacccgtaggggttcggggtcggtcggggtaacgtaggtaccgttccaacccttcgtaacccacccgtaaatccgaacgaccgacggtccctggtacgtacggttacctaaggggttaaaattcgggtttttacggtaaacggtttttacttaccgttacgtacgagtaccgttaagttagtacggttaacgtaacggtcggttacttacgttacgtttcgggttacggaccgggtaacgggtaccgtagacgggtaagtactacggtaggaacgggtacgtacggtcggtacgcggtactactaccg

SEQ ID NO: 336167 - DNA, 560 bp, Homo sapiens
  misc_feature: GZ8MTXP02F7FZW.4.34.D01.1.454.CMB.2.raw
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (332)..(332): a, c, t, g, unknown or other
  misc_feature (332)..(332): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagcccacctctcctgcagggccagtcagagtgtagcagcaacttagcctggtaccngacaagaaacctggccaggcctcccgaggcctcctcatctatggtncactccacgacgggccacgtggtacnccagccaggttcagtcgcctaggtgggtctggggacaggtacgttcactcacaccatcagcagcctgcagtctagtagtatttgtacgtttatactgtacagtactagtatagtacgttaacgtggtactacgttactacggttttacggacggtaacggggaccgaaaggtcgtagggaacgtacgtacggaacggtcgtaacgtggtcggtacgtacgactaaccg

SEQ ID NO: 336168 - DNA, 587 bp, Homo sapiens
  misc_feature: GZ8MTXP02HGAXN.4.34.D01.1.454.CMB.2.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagcccaccctctcctgcagggccagtcagagtgtagcagcaacttagcctggtacctgcagaaacctggccaggctccagcctcctnatctatggtncactccacgagggcccagtggtaactcccagccaggttccagtcnccgtaggtgggctggggacagacgttcactctaccacactcagcacgcctgctagtactagtaagttagttttcggtacggtttaattaaccgttggttacctaagtaccgtaagtaagttgtaaacttaacgtggtacgttacgtaacgttacggttttacgggaccggtaaacggggaacctaaggacgtacggagtacgtacgaaggtaccgaaagtcggtaggtctacggactaaccg

SEQ ID NO: 336169 - DNA, 599 bp, Homo sapiens
  misc_feature: GZ8MTXP02HZ9IR.4.34.D01.1.454.CMB.2.raw
  modified_base (296)..(296): a, c, t, g, unknown or other
  misc_feature (296)..(296): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgttagcagcaacttacgcctggtacctgcacgaaacctggccacggctcccgaggcctccnactcttagtggtcgcactcccaccgacgggcccacgtcgggtacctcccgacgtccgtacggttcacgtcgaccgtaggtcggggtctggggacagtacgttcactcacaccatcgacgcacgccgtgcacgtacgtaggtaagttagtttacgtacggttttattacgttacgttacgagtacgtagtagtagtaactaacgtgtacttagtacgttacgtttacggacgtacgggtaccgaaacggtacgtaggacgtacgtacgaacggtacgtaacgtcggtagtccgtacgctaaccg

SEQ ID NO: 336170 - DNA, 716 bp, Homo sapiens
  misc_feature: GZ8MTXP02IPF3L.4.34.D01.1.454.CMB.2.raw
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgccaccctctcctgcgagggccagtcagagtgtagnagcaacttcgcctggtacctgacaagaaccgnggccaggcctccgagcctcctnactcgtagtggtcactactacccgaaccgacgggacccctaaggttcggtaacctccccgaacggtaccccgttaagggtttaccgaaggtccggacccggttaaggggtccggggttacgtacgggggactaacgggttaaaccgtttcccaaacccttcccgtaacccaaacctaacgttacccgtaacgtacccgaccgtcccgttacgggacctaacggttacgtaacggtaaagtttaggtttttacgggttaaagtttttacgttaacgttgttacgagtacgtagtaacgtagtaacgttaacgtgtacgtagttaacgttacggtttacggaaccggttagggaccgaaagtcggtacggtacgtacgtacggaacggacgtaacggtggtacgtccgtacgacctaaccg

SEQ ID NO: 336171 - DNA, 563 bp, Homo sapiens
  misc_feature: GZ8MTXP02GSWKD.4.34.D01.1.454.CMB.2.raw
  modified_base (300)..(300): a, c, t, g, unknown or other
  misc_feature (300)..(300): n is a, c, g, or t
  modified_base (436)..(436): a, c, t, g, unknown or other
  misc_feature (436)..(436): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaacctggccaggctccaggcctcctcatctatggtncactccaccacgggccacgtcggtactcccgagtccacggttcacgtgccgtagtgggtctggggacagtacgttcactctcacactcagcagcctgcagtctagaagtactttgtcggtttattacgtgtaaagntaggtatacgtaataagtggtacgttagttacgtaacgttttcggaccggttaacgggggacctaaaggtacgtagggacgtacgtacgacggtaacgtaacgtggttacggcgtgaccgtactacg

SEQ ID NO: 336172 - DNA, 662 bp, Homo sapiens
  misc_feature: GZ8MTXP02JLHCZ.4.34.D01.1.454.CMB.2.raw
  modified_base (313)..(313): a, c, t, g, unknown or other
  misc_feature (313)..(313): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcgacgggccagtcagtagtgtagcagctaacttagcctggtacctgacaagaaacctggaccacggcctccgaggcctcctcatctatggncactcccgaccgtacgggccctacgtcggtacctcccgagtccgtacgggttcaacggtcgaccgtagggtcggggttccgtgggggaacctaggtacgttccaacttccaccgacctactacgaacgcacggtctaggactacgtactaggtaagttagtttcggttaccggtttattactaggtaccagtacgtaagtataggaactttaacgcggttacttacgtaacgttacggtttacgggacccggtaaagggggtaaccctaaaggttccggaaacggttagaacgtacggaaacgggtacccgtaaaggttacgggtgacccgttacggaccttaaacccg

SEQ ID NO: 336173 - DNA, 590 bp, Homo sapiens
  misc_feature: GZ8MTXP02F5Y50.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgtagcagctaacttagtctggtacctgacagaaacctggccaggcctcccgaggcctcctcatctagtggtgcatcccaccgacgggccacgtgtactcccagccgtacggtcagtcgccgtaggtcgggtcgtggggactaggtacgttccactctaccacctatccgagcacgcctagctagttctaggtaagttagtttcgttacggttttattacgttcgtacaggtactaagtatagtaattaacgtggtcttagtacgttacgtttcgggacggtaacggggacctaagggtcgtagggactacgtacggaaggtaccgtaagttcggtaggtctcggacctaaccg

SEQ ID NO: 336174 - DNA, 630 bp, Homo sapiens
  misc_feature: GZ8MTXP02I0D7Y.4.34.D01.1.454.CMB.2.raw
  modified_base (411)..(411): a, c, t, g, unknown or other
  misc_feature (411)..(411): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagactaacttcgcctggtacctgacagaaacctggccaggcctcccgaggcctcctactatctagtggtcaccactcccgaccgacggggccctacgtcggtaactccccgagtccaggttcagtcgaccgtaggtcgggtcgtggggacaggtacgttccaccttcncaccatcagcacgcctgctacgttcgtagttaagttacgttttaggttacggttttattacgttgtactagtacgtaagttacgtagtaacttaaccggtgtacgttagtacgttacgtttacgggacccggtaaggggtaaaccctaggacgttaggggaactacggtacggaacggtaccggtaaacggttggtacggtaccgttcggacctaaccg

SEQ ID NO: 336175 - DNA, 670 bp, Homo sapiens
  misc_feature: GZ8MTXP02ICQHK.4.34.D01.1.454.CMB.2.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (346)..(346): a, c, t, g, unknown or other
  misc_feature (346)..(346): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtcctccgaggggacagacgcccaccctctcctgcgagggccagtcagagttgttagcagactaacttacgcctggtacctgcaagtaaaccnggaccaggcctccgaggcctcctnattctagtggtcncatcccaccgagggccacgtggtacccnccagccgtacgttcacgtcgacgtaggttcggtacgtcgggactagtacgttacctacgtccacaccactacgacgaccgacgtccgtacgtacgtagttacggtaggttaacgtttacgttttacggtttaaccggtttttactttacgtcggttacgtacggttacgtaagttacgtaagttaacgtaacgttaggttacgtttacgtttacgtttacggttacggaccgggttacgggtaaaccgtacgggtacggtacggaacgttacggtacggtaacggtacgtaacggttcggtaccggaccgtacggtacctaccg

SEQ ID NO: 336176 - DNA, 584 bp, Homo sapiens
  misc_feature: GZ8MTXP02FP0ME.4.34.D01.1.454.CMB.2.raw
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (487)..(487): a, c, t, g, unknown or other
  misc_feature (487)..(487): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgccagggccagtcagagtgtancagcaacttgctggtacctgcagaactgccagctccngctccnatctatggtcncactccaccgngggccacgtgtacnccagcctaggttcacggtgccgtaggtcgggtactgggggacaggtacgtttaccaccttcacctaaccctataccgaacgccaaacgccccgttagacacggttacgtaaggttaacgttagttttcggttacggttttaatacctggttacagtacgagttaangtaagtacgtgcctagtcttacgttcggaccgagggtaccaagtcgtaggacgtactacggaacggaccgtaacggttggcgtcgtacgctaaaccg

SEQ ID NO: 336177 - DNA, 647 bp, Homo sapiens
  misc_feature: GZ8MTXP02HBQF2.4.34.D01.1.454.CMB.2.raw
  modified_base (321)..(321): a, c, t, g, unknown or other
  misc_feature (321)..(321): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggaagaaatagtgatgacgcagtctccaggcaccctgtctgtgtctccgaggggacagacgcccaccctctcctgcacgggccagtcagagtgttagcagactaactacgcctggtacctgcaacgaacctcggccacggcctcccgaggtcctccgtatactcgtagtggtcncactccgaccgaggcctacgttcggacctaccgagtaccgtacggttacgacgtcgaccgtggggttacggggttccgtaggggactacggttacgttaccaccttacgtaccaaaccctagtaccgaacgacctacggtcccgtgtactacggttactagggtaaacgtttacgtttcggttacgttttaactacgtacgtcgtaagtacgtaagttacgagttacgttacgtcgtacgttacgttaacggttacgtttcgggaccgtagggactaggcgtaggactacggtgaacggtcgtaacgtggtcgacgtacgactacg

SEQ ID NO: 336178 - DNA, 581 bp, Homo sapiens
  misc_feature: GZ8MTXP02F32DC.4.34.D01.1.454.CMB.2.raw
  modified_base (261)..(261): a, c, t, g, unknown or other
  misc_feature (261)..(261): n is a, c, g, or t
  modified_base (285)..(286): a, c, t, g, unknown or other
  misc_feature (285)..(286): n is a, c, g, or t
  modified_base (294)..(294): a, c, t, g, unknown or other
  misc_feature (294)..(294): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagcaacttgcctggtaccngcagaactgccagctccgagctcnntctagtgngcatcccacgacgggccacgtcgtactcccagcctacggtcagtcgccgaggtcggggtctggggacaggtacgttcgactctaccaccatcgagcgagtccgtgacgtagtcgtagtaagttagtttagttacggtttattacgtgtactagtactagttagtagtaacttaacgtggttactacgttacttacggtttacggaccgtaacgggggtaacaaggtcggtacgggtagtacgttaggaacggtacgtaacgtcggtacgtacgacgaccgttaaccg

SEQ ID NO: 336179 - DNA, 575 bp, Homo sapiens
  misc_feature: GZ8MTXP02FK5IM.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagagccacctctcctgcagggccagtcagagtgtagcagcaacttgctggtacctgcagaaacctggccaggcctcccaggcctcctcatctatggtgcactccaccgacggggcccaacgtggtactccccgagccgtaacggttcacggtcgaccgaaggtcggggtcgtgggggacaggtacgttaccactctacaccatcagcacgcctgcagtctaggtaagttagttttgtacggttttaatacgtgtacagtactaagtactagaattaacgtggtactacgtacgttacgttcggacggacggaacgtagtacggtaggaacgtacgacggaacggtaacgtacggtggtcgtacgacgactaac

SEQ ID NO: 336180 - DNA, 555 bp, Homo sapiens
  misc_feature: GZ8MTXP02G4IFT.4.34.D01.1.454.CMB.2.raw
  modified_base (301)..(301): a, c, t, g, unknown or other
  misc_feature (301)..(301): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagctaacttagcctggtacctgcaagaacctggccaggctccagctctcatctatggtncatccacgacgggcccacgtggtactccccgagccgtaaggttcagtcgccgtaggttcgggtctgggggactaggtacgtttccaacttctacaccacgtcagccaggcctgactagtctagtattatttgtacgtttattactcgtacagtactagtagtagtataacgtgtctagtactacgtttcggacgtaacgggacctaggcgtaggacgactacggaacggtacgacgtggtcggctacggactac

SEQ ID NO: 336181 - DNA, 568 bp, Homo sapiens
  misc_feature: GZ8MTXP02JK2WV.4.34.D01.1.454.CMB.2.raw
  modified_base (304)..(304): a, c, t, g, unknown or other
  misc_feature (304)..(304): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagacgccaccctctcctgcagggccagtcagagtgtagcagcaacttagcctggtacctgcaagaaacctggccaggcctcccaggcctcctcatctatggtncactccaccgacgggccacgtggtactcccaggccaacggttcagtcgccgaggtcggggtctggggacaggtacgttcactctacacatcagcacgctgcagtctacgaagttagtttgtacgtttattacgttcgtacgagtctaaggttatagtaattaacgtggtacttacgttacgttacgtttcgggaccggtaggggaaccgtagacgtacgggagtacgtacgaacggacgtaacgtcggtacgcgtcgactaccg

SEQ ID NO: 336182 - DNA, 761 bp, Homo sapiens
  misc_feature: GZ8MTXP02GJ2X2.4.34.D01.1.454.CMB.2.raw
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
tcagagcactgtagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccggacaaccgtcgcccggaccaacatacgccttcctcccgtccccccttcgcaagtaacaccaagtacaggaatattaacctcgttccatcgactacgccttcgctcgccgtagggcactcacctgccccgtattacgtgacaggaccttggtctccggcgngcggtctttcgaccgtntttatccgttactatgcagctattcgcctacttctacgtaacttacccgtccagtacctagtccgtacccttacaaccgaacgtacccaacccgtaccctttaccgaacctaacggggtacccttaaaaccgtaaacccggtaaacccgtacccccgttaaccccccctaaaacccctaaaacccaaacccggtaaccctaaaacgtaaaccggtccggttaccggaccgttccggaccccggacgtaacggttcccggtttacgggtcggtaccgttaacgggtttaccggtttttaacccggtcccccggtttttacctaaccgtttcccccggttcccccgtacccgtaacctttcccggttacgtaaaccgtttaaccgg

SEQ ID NO: 336183 - DNA, 737 bp, Homo sapiens
  misc_feature: GZ8MTXP02HPDMU.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccgaggcctcctcatcctatggtgcactccaccgacgggcccacgtcggtactccccgacgcctacggttccaagttcgcccgagggttcggggtcgttcgggggaaccaaggtacggtttacccaaccgtttcctaccaaaccccattaccacggaccaacggcccctagtccgtaacgttaccgttaagggtaaacgttagtttttacggttacgggttttttaaacctttaccggtttactttaccgaagttacccggttaaagtttaagtaggttaaacgttaaaaccgttgggtaaccgtttacgggtttaaaccgttaacggttttttaccggggacccggggtttaaaacggggggaacccctaaaagggtccggtttacgggaagttaacgttaccggaagggtaccgtaaacggttccggtaggggtacctttcggaccgttaaaccc

SEQ ID NO: 336184 - DNA, 609 bp, Homo sapiens
  misc_feature: GZ8MTXP02H6DD7.4.34.D01.1.454.CMB.2.raw
  modified_base (170)..(170): a, c, t, g, unknown or other
  misc_feature (170)..(170): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagagcactgtagcacgaccggtgctcgatttagatcgtctgtgttgggtttggggaggaactgctcagttaggacccagacggaaccatggaagccccagcgtagcttctcttcctcctgctactctggctcccagaaaccactggagaaatagtgatgacgcagtcnccaggcaccctgtctgtgtctccaggggacagacgccaccctctcctgcagggccagtcagagtgttagcagcaacttagccttggtacctgcagaacctgccagctcccagctcncatctatgtncactccacgnggcccagtggtactccgagcctaggttcccagtcgcccgtaggtcggtctacggggcaggtcttccgacctccgtacaacccgntacacgcagcctaggcgtaagtcctagtaacgttagttttaggtacgtttttacgttacgttcgttacgtaccgtagttagttagttacgtaagttaacgtggtacgttacgttaaccgttacggttttccggaaccggtacggggacccaaaggttacgaggtacgacgtacggtacgaacggtaacgttcggtacggtctacgaccctacgttaacg

SEQ ID NO: 336185 - DNA, 691 bp, Homo sapiens
  misc_feature: GZ8MTXP02FNW2C.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggataaatagtgatgacgcagtctccaggcaccctgtctgtgtctccgaggggacagacgcccaccctctcctgcgacgggccagtcagagtgttagcagctaacttagccgtggtacctgcagaaacctggaccaggcctcccgaggtcctccgtctatctagtcggtgcctactcccaaccgacggggcccacgttacggtacctccccgagccctaggtttccaggttcgaccgtagggttcggggtttacgggacgacgggtacgttccaaccgttctacccaaccgtataccgagtacccgacgtcccgtcgcccgtacgtccgttaggtaaagtttacgttttacggttacgggtttttaactttaccgttggttacgtacgtacgtaaggttataggtaaacgttacgtacgggtacgttacgttaacgttcggttttacggaccggtaacgggggtaacccaagggtccgttaaggacggtacgttaccggaagggtaaccgaacgttcgggtacggtcgtacgacgacctttacg

SEQ ID NO: 336186 - DNA, 747 bp, Homo sapiens
  misc_feature: GZ8MTXP02JWOAY.4.34.D01.1.454.CMB.2.raw
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
tcagagcactgtagcacgaccggtgctcgatttagatcgtctgtgttgggtttgggggaagaggaagactgacggtcccccaggagttcaggtgctgggcacggtgggcatgtgtgagttttgtcacaagatttgggctcaactttctgtccctaagactctcctgtgcagcctctggattcacctttagtacctatgccatgggctgggtccnccaggctcctgggaaggcctggcgtgggtctcaggaattagtactagcggtggccatacatactacgcagattccgtgaaggccgattcacatctccaggacaactcaagaacncgctgtatctgacaaaagtcgaacagcctaggacgacgccggaggaccaacgggtcccgtttttaattccgtaggttacgaccggtaaaacgttccccgggggttaggggtagggggtaacgtttaagttacgtaacgtcggtacccgtaaggttcgacgtaacgtaaacgttcccgggttacgggggacccgtaacgggggtaaccccgttacgggttaacccgtaacccgttacccgtcccgttaccgaaccgtccccgtttaaccccgaacccgggtaaaaccggggtcccccgtaacgtttaccccggggttacccttaccccccggttcgggtaccccctaaccccgtttccccgtacccgtaaacggaccgtacccgtaccgtccggttaccgggggacctacgtacccgggg

SEQ ID NO: 336187 - DNA, 606 bp, Homo sapiens
  misc_feature: GZ8MTXP02JZL8T.4.34.D01.1.454.CMB.2.raw
  modified_base (456)..(456): a, c, t, g, unknown or other
  misc_feature (456)..(456): n is a, c, g, or t
tcagagcactgtagcacgaccggtgctcgatttagatcgtctgtgttgggtttggggggaagaggaagactgacggtccccccaggagttcaggtgctgggcacggtgggcatgtgtgagttttgtcacaagatttgggctcaactttcttgtccctaagactctcctgtgcagcctctggattcacctttagtacctatgccatgggttggtccgccaggctcctgggaagggcctggcgtgggtctcaggaattagtactagcggtggccatacatactacgcagatccgtgaaggccgattcaccatctccaggacaactccaagaacacgctgtatctgacaaatgaaccagcctagagagccgaggcacgggtccgtttattctgttacgaaacggtcccgggggtaggggggggtacttagttatacgtgccgtagttgacagaactcgnggggccgacgggacccgtcggtaccaccgtctccctcacgccctaccgaccgacgggcccacgtccggtcccttcccccgtcggcccctaccctccctaccgaacgacgccgaaccgtcggtcgggggcaccgacggcccggccgtcggg

SEQ ID NO: 336188 - DNA, 641 bp, Homo sapiens
  misc_feature: GZ8MTXP02J11N1.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccaagaaaccactaggagaaatagtgatgacgcagtctccaggcaccctgtctgtcgtctccgagggacagacgcccaccctctctgcgagggccagtcagagtgttagcaagctaacttagccctggtaccctgcaacgaacctggaccaggccctcccgaggtcctcctcatcgtagtaggtcgactacgtcccaccggacgggccacgttcggtacctcccgaggccctaggttcagtcgccgtagggtcggtacgtggggaactaggtcgttcaaccttcgtacaccactacacgacacgtccgtgcgtacgtacgtagtaaacgttagttttacggttaccggtttattacgtacgttaccgagtacgtaagttacgtagtaacgttaaggtcgtaccgtttagttaacccgttacgtttacgggaccggtacgggtaaccgtaaacggtcgttacggagtacgttaacgaacgtaccgagtcgtacggctacgactaccg

SEQ ID NO: 336189 - DNA, 546 bp, Homo sapiens
  misc_feature: GZ8MTXP02IC8RZ.4.34.D01.1.454.CMB.2.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgcagggccagtcagagtgttagcagcaacttagcctggtacctgcagaactggccagctccagctcctnatctatgtncatccacagggccacgtggactcccagccaggttcagtcgccgaggtgggtctgggacagtacgttcactcacaccatcagcagcctgcagtctagtaagttacgtttgtacggttttattacgttgtactagtcgtagtagtagaacttaacgtggtcttacgtacttacgttttcggacgtacggggaccaaacggtcgtacggagtagtcgaacggacgtaacgttggtacgtcgtcgacgtaccg

SEQ ID NO: 336190 - DNA, 622 bp, Homo sapiens
  misc_feature: GZ8MTXP02HRZAJ.4.34.D01.1.454.CMB.2.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
tcagagcactgtagcacgaccggtgctcgatttagatcgtctgtggttgggtttgggggaggaactgctcagttaggacccagacggaaccatggaagccccagcgcagcttctcttcctcctgctactctggctcccagaaaccactggagaaatagtgatgacgcagtctccaggcacccctgtctggtgtctccgaggggacaggacgcccaccctctcctgcagggccagtcagagtgtagcagcaacttagcctggtacctgcgagaaacctggccacggctccaggctcctnatctagtgntccatccgaacngggtccacgtcggactccccgagcctaaccgggtcaggtcgacgtaggtcggggtntcggggactagacgttcaacgtctacgactatcacgcacgcctagactacgtctagtaagttagttttacggtcggttttaatttaccgttaggttcgtagtaccggtaagttacgtagttaactaaacgttcggtacgtacgttacgttaccggttttacggacccggtaacgggggaacctaacgggtacgttacggagtaacgttgaacgggtacgtaacgtggtaacgggtctcggtacgacc

SEQ ID NO: 336191 - DNA, 757 bp, Homo sapiens
  misc_feature: GZ8MTXP02GWDEQ.4.34.D01.1.454.CMB.2.raw
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcgagggccagtcagtagtgttagcagactaacttagccttaggtactgacaaggaaacctgggaccaggtcctacccgaggtccctaccactatcgtagtggtcgaccactcccgaaccgacggggtccctaccgttacggtacctccccgacggtacctacggggttaccacggttcgacccggtagggttcggggttacgtgggggtactaaggtaccgttccaacttcctaccactaacgtcacgtaccgagcccgtcgaccgttacggttacgtaagggttaagtttacgttttacgggtttacggtttttaacgttaccgttacgttaacggacgttacggtaagttacgttaaggttaaacgttaacggttcggttaccgttacggtttaaaccgttacgggttttaaccgggaacccggggttaaacgggggaaacccgtaagggttaccggttaacgggacggttaaccgtaacgggtaacgggtaaccggtaacgttcgggttcggggacctcggtaccttaaccgg

SEQ ID NO: 336192 - DNA, 540 bp, Homo sapiens
  misc_feature: GZ8MTXP02G4MN3.4.34.D01.1.454.CMB.2.raw
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
  modified_base (510)..(510): a, c, t, g, unknown or other
  misc_feature (510)..(510): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggccaccctgtctgtgtctccgaggggacagagccaccctctcctgcagggccagtcagagtgttagcagcaacttgcctggtacctgacagaaacctggccaggcctcccaggctccncatctatggtcncatccaccaggggcctacgtcggtaactcccgagccaggtttcagtcgaccgaggtgggtctggggacaggtagttaccactctcaaccatcagcacgcctgcagtcagaatattttgtacggtttattactgtacngatagtatgaataacgtgcctagttacctgtttcggaccgaaggggacccaaaggccgtaggaacgancgaaagggcaaacggttgacggcgcgacac

SEQ ID NO: 336193 - DNA, 640 bp, Homo sapiens
  misc_feature: GZ8MTXP02GTHLJ.4.34.D01.1.454.CMB.2.raw
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaacccatggaagaaatagtgatgacgcagtctccaggccaccctgtctgtgtctccgaggggacagacgcccaccctctcctgcagggccagtcagagttgtagcagactaagttagcctaggtacctgacagaaaccgtgccagcctccgagctcctnatctagtggtnccactcccaacgtcgggaccacgttggaacctcccgaggtcctacggttacaggttcgaccgtagggtcggtacgtcgggggaactaggtacgttccaaccttctaaccgaccaaaccgtacgacgacgtacgcgtacgacgtacgtacgttaaggttaaagtttacgtttaggttaaccgttttaattacgttagtacgtaggtacgtagttaagtacgtaactacggtgtacgttacgtacgttacggttacggaccggtaaagggtacctaggtcgtaggaacgtacgtaagaacggtacgaacggtcggtacggactacgactacg

SEQ ID NO: 336194 - DNA, 663 bp, Homo sapiens
  misc_feature: GZ8MTXP02GZ0NI.4.34.D01.1.454.CMB.2.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtcgtctccgaggggacagacgcccaccctctcctgcagggccagtcagagtgtagcagcaacttcgcctggtacctgacagaacctggccaggcctcccgagctccnctatctagtgtcncactaccaccggacgggaccctagtcggtacctccccgagtccgtagggttcagttcgccgtagggtcgggttcgcgggggactaggtacgttaccaccttccgtaccaaccctactacgaacgcccgaacggtccctcggtacgtacggttacctagggttaaacgtttacgttttacgggtttaaccgggttttactttacgttacggttactacggtacgttaagttacgtagttaacgtacgttcgttacgttacgttacgttacggtttacggacggacggggtaccaaaggtcggtaggacgtacgtacgaacgggtaacgtacgttacggtcgtaccgtacgacctacg

SEQ ID NO: 336195 - DNA, 613 bp, Homo sapiens
  misc_feature: GZ8MTXP02FP65B.4.34.D01.1.454.CMB.2.raw
  modified_base (311)..(311): a, c, t, g, unknown or other
  misc_feature (311)..(311): n is a, c, g, or t
tcagagcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgcccaccctctcctgcagggccagtcagagtgttagcagcaacttagcctggtacctgacacgaaacctggaccaggcctcccgaggcctcctcatctagtggtncactcccaacgacgggccacgtacggtactcccgacgtccgacggtttccagtcgccgtagggttcgggtaccgtggggaactaggtacttccacgtctaccaccatacacgcgacgcctgacaggtcgtagtaagtttagtttcgttacgttttacttacgttcgtactagtacgtagttagtagtatacgtgtacgttcgtacgttacgtttacgggaacgtacgggggtaaacctaggtacggtaggtaagacggtacgaacgggacgtaacggtcggtaggccgttacgacttaaccg

SEQ ID NO: 336196 - DNA, 566 bp, Homo sapiens
  misc_feature: GZ8MTXP02HUOSB.4.34.D01.1.454.CMB.2.raw
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
tcagagcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcacccctgtctgtgtctccaggggacagagccaccctctcctgcagggccagtcagagtgttagcagcaacttagcctggtacctgcagaaacctggcaggcnccaggctctnatctanggtncatccacagggccatggactcccgagccaggttcagtcgccaggtcgggtctggggtaccaggtactttcgactcgtaccaacctatcagcagcctgcacgtctagtaagtatttcgtacggttttatttacgtcgttacagtacctagttatagaattaacgtcggtacgttgttaccgtaacgttttcgggaccgtagggggaaccctaaaggtcgtagggacgagtaccgaaggacggtaactgggtcggacgtcgacgtaaccg

SEQ ID NO: 336197 - DNA, 620 bp, Homo sapiens
  misc_feature: GZ8MTXP02FK962.4.34.D01.1.454.CMB.2.raw
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctcgaggggacagacgccaccctctcctgcgacgggccagtcagagtgttagcagctaacttagcctggtacctgcaagaacctggaccaggcctccgagcctcctctatctagtggtncactccacgacgggccctagtcggtaacncccgagtccgtacggttcagtcggccgtagggtcggggtcgtgggggactaggtacgttacctacttcctacgaaccctacgtacgacgtccgaacgcccgttgacgtaacggttctaaggtagtttacgttttcgttacggtttacttacgtgtactagtcgtagtatagtacgtacgtgtcttacgtacttcggtttacggacggtacggggaacctaggtacggtacgtaagacgtacggaacggtacggtaacgtgggtaccgcgtcgacctaaccg

SEQ ID NO: 336198 - DNA, 659 bp, Homo sapiens
  misc_feature: GZ8MTXP02GAXT1.4.34.D01.1.454.CMB.2.raw
  modified_base (242)..(242): a, c, t, g, unknown or other
  misc_feature (242)..(242): n is a, c, g, or t
tcagagcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccgaggggacagacgccaccctctcctgccagggccagtcagagtgtancagactaacttagccctggtacctgactacgaaacctggaccacggcctcccgaggtccttcctcaacttccgtagtcggtcgacctactcccgaaccggacgggccctaaccggttggtacctacccgacggtccctagggtccaggtccgaccgtagggttcgggttcgtcgggggacaggttacttaccgacttcaccactacgtcaacgcacgtcctgactacgtagtaagtaacgttagtttggttaacggttttacttacgtcgttacgagtacgtagttataggtaacttaaggtcggttactacgttaccttaaggtttcggacgggttaaacgggacctaaaggtcggtaacggaaggtacgtacggaacgggtaccgtaacggttcggacggtactcgacgtaaccg

SEQ ID NO: 336199 - DNA, 516 bp, Homo sapiens
  misc_feature: GZ8MTXP01DWUC7.25.34.D01.1.454.CMB.2.raw
  modified_base (190)..(190): a, c, t, g, unknown or other
  misc_feature (190)..(190): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (410)..(410): a, c, t, g, unknown or other
  misc_feature (410)..(410): n is a, c, g, or t
  modified_base (510)..(510): a, c, t, g, unknown or other
  misc_feature (510)..(510): n is a, c, g, or t
tcagactgtacagtcacgaccggtgctcgatttagatcgtctgtgttgggtttggggagagaagacaggattcaggacaatctccagcatggccggcctccctctcctcctcaccctcctcaatcactgtgcagggtcctgggcccagtctgtgctgactcagccaccctcagtgtctgggacccccggnagaggtctccatctcttgttctgggagcagctccgagtcggaaatagttgtctactggtaccagcagctcccagaaacggcccccaagctcctcatctataggaatgatcagcggcccctnagggataccctgaccgattcnctggctcccaaggtctggcacctcagcctccctggccatccaggtggggtccagtctgagatgaggctgcttattacngcgcagcgagtggggatggacagcctgaaagtggtgtgggtttcggcgggtaagggcgaagcgttgaccgtcagttcagcccaggctcgccccttggtcncgtccg

SEQ ID NO: 336200 - DNA, 530 bp, Homo sapiens
  misc_feature: GZ8MTXP01D5A3R.25.34.D01.1.454.CMB.2.raw
  modified_base (526)..(526): a, c, t, g, unknown or other
  misc_feature (526)..(526): n is a, c, g, or t
tcagactgtacagtcacgaccggtgctcgatttagatcgtctgtgagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctctgggggtttctagtcgatttcactggctccaagtctggcaacacggccctccctaacaatctctgggctccaggctgaagacgaggctgtttatttctgctgttgctatgtggctagaaaactaatttggtgctcggcggtagggaccctaattgaccgtctaagtcagccaaggctgccccttggttcaactctcgttcccacccttctcnctcg

SEQ ID NO: 336201 - DNA, 727 bp, Homo sapiens
  misc_feature: GZ8MTXP01BDHE2.25.34.D01.1.454.CMB.2.raw
  modified_base (246)..(246): a, c, t, g, unknown or other
  misc_feature (246)..(246): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaagggagacagcctacaagaagcttaattangacaagctaggtacccagcaagaacgccgaaggacgcggcccctgtacttgcatctaagtaacggtaaaaaccacccggccctacgaacgggactaccccgagaccgtacttcctccgtcggaccttacccgaagtccctaaaccgaaacgggaaacccaccgtaacgttccctttaccccgttacgaacccctacgttacccgtaaccgggttacgggggcccttaccgggaaggggaccgggaaaggtaacgtagggaacggtccgtaggtaaacctttaacgtttaaccgttaccggttaaaccccggggttaccccggggaaacgaacggtaccgtaaggttaaccggtaaacccttaagttaaactttgtcgttaccgttacggaaacgtcgggaaccttaacggtccttaccgtacgtacggttacaccgacccgaacggacccaacccacgtcttacctaaccttccgttcccg

SEQ ID NO: 336202 - DNA, 525 bp, Homo sapiens
  misc_feature: GZ8MTXP01CB181.25.34.D01.1.454.CMB.2.raw
tcagactgtacagtcacgaccggtgctcgatttagatcgtctgtgagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctctggggtttctagtcgattcactggctcaagtctggcaacacggcctccctaacaatctctgggctccaggctgaagacgaggctgttattctgctgttgctatgtggctgaaaactatttggtgctcggcgagggccctaattcgaccgtcttaaagtcagcccaaggctgccccttggttccaactctgttcccacactccttctaaccg

SEQ ID NO: 336203 - DNA, 551 bp, Homo sapiens
  misc_feature: GZ8MTXP01BE6NL.25.34.D01.1.454.CMB.2.raw
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctctggggtttctagtcgattcactggctccaagtctggcaacacggcctccctaacaatctctgggctccaggctgaagacgaggctgtttattctgtctgttgctatgtggctagaaaactagtttggtgcgtcggcgggaagggaccctaaagttcgaaccgttcttaaacgtcacgccccgaaggcctcgcccccgttggttccaacgtctcgttcccacccttcctcaacttcg

SEQ ID NO: 336204 - DNA, 501 bp, Homo sapiens
  misc_feature: GZ8MTXP01CYTQK.25.34.D01.1.454.CMB.2.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggaccccggnagagggtctccatctcttgtctgggancagctccgacgtcggaaatagttgtctactggtaccagcagctcccagaaacggccccaagctcctcatctataggatgatcagcgccctnagggatacctgaccgattctctggctcgagtctggctcctcggcctccctgccatcagtggctccggtcgagatgagctgaatatactgtgcagtttgggatgggccaggtcngagtgtcccgaggtgtcggcgagggccaagctgaccgtcaggtcngcccgagctgccccctggtccncttctcgttcccnc

SEQ ID NO: 336205 - DNA, 532 bp, Homo sapiens
  misc_feature: GZ8MTXP01DLWWE.25.34.D01.1.454.CMB.2.raw
  modified_base (206)..(206): a, c, t, g, unknown or other
  misc_feature (206)..(206): n is a, c, g, or t
tcagactgtacagtcacgaccggtgctcgatttagatcgtctgtgagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacacccggacaaaggctccaaactcataattttgagaccagtaagcggcctctggggttctagtcgattcactggctccaacgtctggcagcaacggcctccctgacaatctctgggctccaggctgagacgaggctgattatactgctactcatatggacaacatcaacaaatcccgtacttcggacctgggaccagggtcaccgttctgggttcacgcccaagggcccaaaccccgaactcgtcacctcttcgtttccccgccttcccc

SEQ ID NO: 336206 - DNA, 569 bp, Homo sapiens
  misc_feature: GZ8MTXP01BQH94.25.34.D01.1.454.CMB.2.raw
  modified_base (358)..(358): a, c, t, g, unknown or other
  misc_feature (358)..(358): n is a, c, g, or t
  modified_base (434)..(434): a, c, t, g, unknown or other
  misc_feature (434)..(434): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagagcaggacaggcccctgtactgcatctatacggtaaaaacacccggccctcgaagggactaccccagacccgattcctcctggctccagctacaaggaaccncagtcttcctgaccatcacgtggggctcgagggcgaagagtgaggctagactattacgtagtaacgtcccgggganacgctacgtaggtaaccattaaattatgtacgttacggaacgtaacgggtaaccaacgggttccaccggttaccttaagggccgacgaccccaaagggcccctaaacccacgtcgttacctaaccttcgtccccg

SEQ ID NO: 336207 - DNA, 527 bp, Homo sapiens
  misc_feature: GZ8MTXP01EMWCA.25.34.D01.1.454.CMB.2.raw
  modified_base (207)..(207): a, c, t, g, unknown or other
  misc_feature (207)..(207): n is a, c, g, or t
  modified_base (370)..(370): a, c, t, g, unknown or other
  misc_feature (370)..(370): n is a, c, g, or t
  modified_base (433)..(433): a, c, t, g, unknown or other
  misc_feature (433)..(433): n is a, c, g, or t
  modified_base (464)..(464): a, c, t, g, unknown or other
  misc_feature (464)..(464): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctgacggtcaatcaccatttccngcactggaaccagcactgatgttggctactttgaccttgtctctggtaccaacaacaccggacaagctcaaactcataattttgagaccagtaacgcgccctcgtggggtttcagtcgattcactggctcaagtctggcaacacggacctaccctaacaatcnctcgggctccgagctgaagacgaggcttgttattctgctgtgctatgtgctgaaactattggngcgtcggcggagggaccctaagtcgaccgtntaagtcagcccaaggcctcgccccgttcggcctaactctcgttccccacccttcctcaactcg

SEQ ID NO: 336208 - DNA, 442 bp, Homo sapiens
  misc_feature: GZ8MTXP01C9YQS.25.34.D01.1.454.CMB.2.raw
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (435)..(442): a, c, t, g, unknown or other
  misc_feature (435)..(442): n is a, c, g, or t
tcagactgtacagtcacgaccggtgctcgatttagatcgtctgtgttgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggtattatggggggcctactactactactacatggacgtctggggcaaagggaccacggtcaccgtctcctcagcctccaccagggcccatcggtcttccccctggcaccctcctccaagagcacctctcgggggcacagcggccctgggctgcctggtcaaggactacttccactgtacagtctgagcgggctgggcaagggccgananagnnnnnnnn

SEQ ID NO: 336209 - DNA, 536 bp, Homo sapiens
  misc_feature: GZ8MTXP01DWK2Y.25.34.D01.1.454.CMB.2.raw
  modified_base (446)..(446): a, c, t, g, unknown or other
  misc_feature (446)..(446): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggcttactttgaccttgtctcttggtaccaacaacacccggacaaaggctaccaaactcataattttgagaccagtaagcgcctctggggtttctagtcgattcactggctccaacgtctggcaacacggccctccctaacaatctctgggctccaggctgaagacgaggctgtttattctgctgtgctatgtggctagaaaactaatttggngcgtggcggaggaccctaagttcgacgtcttaaagtcagccaagctcgccccgttggttccaactctcgttcccgcccttcctcaactcg

SEQ ID NO: 336210 - DNA, 555 bp, Homo sapiens
  misc_feature: GZ8MTXP01EEVUD.25.34.D01.1.454.CMB.2.raw
  modified_base (206)..(206): a, c, t, g, unknown or other
  misc_feature (206)..(206): n is a, c, g, or t
  modified_base (443)..(443): a, c, t, g, unknown or other
  misc_feature (443)..(443): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacggtcaatcaccatttccngcactggaaccagcactgatgttgcttacttgaccttgtctcttggtaccaacaacacccggacaaaggctcaaactcataattttgagaccagtaagcgccctctgggggtttctagtcgattcactggctccaagtctggcaacacggccctccctaacaatctctgggctccaggctgaagacgaggctgtttatttctgtctgttgctatgtggctagaaaactaagtttggngtcgtcggcggaaggggaccctaattcgtaccgtcttaaaggtcacggcccttaaagggcctcgcccccgttcggttctaactctcgttccccgcccttcctccgaacttcg

SEQ ID NO: 336211 - DNA, 547 bp, Homo sapiens
  misc_feature: GZ8MTXP01DC6DQ.25.34.D01.1.454.CMB.2.raw
  modified_base (434)..(434): a, c, t, g, unknown or other
  misc_feature (434)..(434): n is a, c, g, or t
tcagactgtacagtcacgaccggtgctcgatttagatcgtctgtggagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacaccggacaaagctcaaactcataatttgagacagtaagcggcctctgggtttctagtcgattcactggctccaagtctggcaacacggcctccctaacaatctctgggctccagctgaagacgaggctgtttattctgctgttgctatgtgactgaaaactaatttgggngtcgtcgggacggaacggacctaagttcgaccgttacttaacgtcgacgaccgaaggtcctcgttccccgttcgttcctaactcttccgtccccacccttcctcttaacgtcg

SEQ ID NO: 336212 - DNA, 518 bp, Homo sapiens
  misc_feature: GZ8MTXP01ASO44.25.34.D01.1.454.CMB.2.raw
  modified_base (189)..(189): a, c, t, g, unknown or other
  misc_feature (189)..(189): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (450)..(450): a, c, t, g, unknown or other
  misc_feature (450)..(450): n is a, c, g, or t
  modified_base (477)..(477): a, c, t, g, unknown or other
  misc_feature (477)..(477): n is a, c, g, or t
tcagactgtacagtcacgaccggtgctcgatttagatcgtctgtgttgggtttgggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagtttgctactggtaccagcagctcccagaaacggcccccaagctcctcatctataggaatgatcagcggccctcagggatacctgaccgattctctggctccgaagtctggctcctcggcctccctggccatcagtgggctccggtcgagatgaggctgaatnttacngtgcagttgggatgggccagtctgagtggtccgacggtgttcggnggagggccaagctgaccgtccaggtcngcccagggctcgcccctcggtcacttctcgttcccaacccc

SEQ ID NO: 336213 - DNA, 560 bp, Homo sapiens
  misc_feature: GZ8MTXP01ECK3D.25.34.D01.1.454.CMB.2.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (420)..(420): a, c, t, g, unknown or other
  misc_feature (420)..(420): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttgctactttgaccttgtctcttggtaccaaacaacacccgganaaaggctccaaactcataattttganaccagtaagcgcctctggggtttctagtcgattcactggctccaagtctggcaacacgccctccctaacaatctctgggctccgagctgaagacgaggtcttgtttatttctgtctgtgtntatgtgtacgtagtaaataagttaggtgtcgtcggacggacggtaccgtaacgtacgtacgtacgttaacgtacgacgaccgacgtcgtccgttccccgttccgttcctctctccgttccctcccttcctccgttcgtcg

SEQ ID NO: 336214 - DNA, 680 bp, Homo sapiens
  misc_feature: GZ8MTXP01CNJYK.25.34.D01.1.454.CMB.2.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (366)..(366): a, c, t, g, unknown or other
  misc_feature (366)..(366): n is a, c, g, or t
  modified_base (429)..(429): a, c, t, g, unknown or other
  misc_feature (429)..(429): n is a, c, g, or t
  modified_base (518)..(518): a, c, t, g, unknown or other
  misc_feature (518)..(518): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggccctgctgtgtctgtggccttggacagacagtcaggatcaacatgaccaaaggagacagcctanagaagctattangacaagctaggaccagacaagaacgccgaaggacacggccccttgtacttgtacctatacgtaaagtaaaccggtaaaaaaccgacccgggacccctacgaacgggactaccccgaagtaaccgtnttccgtacccgtcggactaccgagtcctaaacgaaagaaccacgtaacgtcccttacccgtanaaccctatccgacgtgggcacgagggacgaagagaggacgtacgtagtaacttaacgttaacgtaccggttaacggaccccggggtaanaacgtacgtaacgttaacgtaaacgttaagttaaacgttacgtacgttaccgtacggtaacggtaacggtaaccgttaacggtccgaccggtacgtacggaccgacccgacccgaaccgacccctaaccgtcgtaccttaccctaaccgttcccgtaacccg

SEQ ID NO: 336215 - DNA, 523 bp, Homo sapiens
  misc_feature: GZ8MTXP01DAZS6.25.34.D01.1.454.CMB.2.raw
  modified_base (190)..(190): a, c, t, g, unknown or other
  misc_feature (190)..(190): n is a, c, g, or t
  modified_base (279)..(279): a, c, t, g, unknown or other
  misc_feature (279)..(279): n is a, c, g, or t
  modified_base (412)..(412): a, c, t, g, unknown or other
  misc_feature (412)..(412): n is a, c, g, or t
  modified_base (455)..(455): a, c, t, g, unknown or other
  misc_feature (455)..(455): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgtctgggagcagctccgagtcggaaatagttgtctatggtaccagcagctccagaaacgccccaagctccnatctatagaatgatcagccggcctgagggatacctgaccgtattctctggctaccgaagtctggcctcccgtcggccctcccgtggcccatccgagtcgggctccgggtcgagatgagctagaattatactgngcagttggatggcctagtctggagtcggtcgacggttgtcggnggaggccaagctgaccgtcaggtcagccgaggcctcggccccctggtccacttcctcgttcccaaccc

SEQ ID NO: 336216 - DNA, 558 bp, Homo sapiens
  misc_feature: GZ8MTXP01CVTN2.25.34.D01.1.454.CMB.2.raw
  modified_base (437)..(437): a, c, t, g, unknown or other
  misc_feature (437)..(437): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacacggcccctgtactgcatctataggtaaaaaccaccggccctacgagggactcccgagaccgattcctcctggctcagctaacaagaacacagtccttctacgaccatcacgtgggctcgagggacggaaagatggagactgaactattacgtagtaaccgtcccggganagacgagtacgtaaaccataactatcggtacttacggaactgggacccaaggtccaccgtccgtagttaccgacgaccccgaacggccccaaccccgtctgttaccctaacgttcctcccg

SEQ ID NO: 336217 - DNA, 534 bp, Homo sapiens
  misc_feature: GZ8MTXP01CPIAS.25.34.D01.1.454.CMB.2.raw
  modified_base (446)..(446): a, c, t, g, unknown or other
  misc_feature (446)..(446): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctaccaaactcataattttgagaccagtaagcggccctctggggtttctagtcgattcactggctccaagtctggtaacacggcctaccctaacaatctctgggctccaggctgaagacgaggctgtttattctgctgttgctatgtggctagggaaaactagtttggngctggcggtagggacccagttcgacgtcttaagtcagcccaaggctcgccccttggcactctcgttcccnccctcnctaacttgtaac

SEQ ID NO: 336218 - DNA, 586 bp, Homo sapiens
  misc_feature: GZ8MTXP01CZ9Q2.25.34.D01.1.454.CMB.2.raw
  modified_base (209)..(209): a, c, t, g, unknown or other
  misc_feature (209)..(209): n is a, c, g, or t
  modified_base (311)..(311): a, c, t, g, unknown or other
  misc_feature (311)..(311): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcacctatttccngcactggaaccagcactgatgttgcttactttgaccttgtctcttggtaccaacaacacccgacaaagctacaaactcataatttgagacagtaagcgcctntgggttctagtcgattcactggctaccaagtctaggacaacaccggaccttaccctaactaactcctcgtcgggcctcccgagctagaagacgaggtcttgtttatttctgtctgttgctagtgtgtagtagtaaataagttaggtgtcgttcggacggacggtaccgtaacgtacgtaccgtcgttaacgttacgacgaccgacgtaccgtccgttccccgttccggttcctaacctccgttccgttcccgtcccttccctccgttaacgttcg

SEQ ID NO: 336219 - DNA, 544 bp, Homo sapiens
  misc_feature: GZ8MTXP01ANQ26.25.34.D01.1.454.CMB.2.raw
  modified_base (483)..(483): a, c, t, g, unknown or other
  misc_feature (483)..(483): n is a, c, g, or t
  modified_base (518)..(518): a, c, t, g, unknown or other
  misc_feature (518)..(518): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggcttacttgaccttgtctcttggtaccaacaacacccggacaaggctccaaactcattaattttgagacagtaagcggccctcgtgggtttctagtcgattcactggctccaagtctggcaacacggccctaccctaacaatctctgggctccaggctgaagacgaggcttgtttattctgtctgttgctatgtggctagaaaactagtttggtgcgtcgggacggtacgggaccctaagttcgtaccgtnttaagtcacgcccaaggctcgccccgttggttccnctctcgtcccaccttcctcaacgtcg

SEQ ID NO: 336220 - DNA, 563 bp, Homo sapiens
  misc_feature: GZ8MTXP01A4MML.25.34.D01.1.454.CMB.2.raw
  modified_base (453)..(453): a, c, t, g, unknown or other
  misc_feature (453)..(453): n is a, c, g, or t
  modified_base (554)..(554): a, c, t, g, unknown or other
  misc_feature (554)..(554): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctcgtgggggtttctagtcgattcactggctccaagtctggcaacaccggccctaccctaacatctctcgggctccgagctgaagacgaggcttgtttatttctgtctgttgtctagtgtggctagaaaactagtttggngcgtcgggcggacgggaccctaagttcgaccgttcttaagtcacgacccaaggcctcgcccccgttggttccaaccgttctccgttccccacccttcctcnccgttaacg

SEQ ID NO: 336221 - DNA, 536 bp, Homo sapiens
  misc_feature: GZ8MTXP01BTHY1.25.34.D01.1.454.CMB.2.raw
  modified_base (438)..(438): a, c, t, g, unknown or other
  misc_feature (438)..(438): n is a, c, g, or t
  modified_base (528)..(528): a, c, t, g, unknown or other
  misc_feature (528)..(528): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctctgggggtttctagtcgattcactggctccaagtctggcaacacggcctccctaacaatctctgggctcaggctgaagacgaggctgtttattctgtctgttgctatgtgctgaaacatttggncgtcgggcggagggaccctaagttcgaccgtctaagtcagtcccaaggcctcgccccttggttccaacgtctcgttccccaccttcctcncgttaacg

SEQ ID NO: 336222 - DNA, 628 bp, Homo sapiens
  misc_feature: GZ8MTXP01B745M.25.34.D01.1.454.CMB.2.raw
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (402)..(402): a, c, t, g, unknown or other
  misc_feature (402)..(402): n is a, c, g, or t
  modified_base (600)..(600): a, c, t, g, unknown or other
  misc_feature (600)..(600): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctcggggacccccgggcaggagggtctccatctcttgttctgggagcagctccgacgtcggaaatagtttgtctactggtaccagcagctccagaaaccggccccaagctcctnatctanagatgatcagcggccctnagggtatacctgaccgtattcctctgggcctaccgaagttctgggcccttcccgtaccgggccccttccccgtagggccctagtccgnggttcgggggcccttcccggggtccgaggacgtggacgggctggaaattagttactgtgcgtaggtttggggattcggggcctaggtctggtagtcgggtcccgagggttcgttcgggcgggacggtaccaaggcttcggacccgtccgttagggtccaacggccccgaaggcccgtccggtccccccttgggtcccnccttcccgttccgtttccccccctcccg

SEQ ID NO: 336223 - DNA, 529 bp, Homo sapiens
  misc_feature: GZ8MTXP01EI0K2.25.34.D01.1.454.CMB.2.raw
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
  modified_base (505)..(505): a, c, t, g, unknown or other
  misc_feature (505)..(505): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttggggacagacagtcaggatcacatgccaaggagacagcctcaagaagctatatgcaagctggtaccagcagaagccaggacaggcccctgtactgcatctataggtaaaaacaccggcctcgaggactcccagaccgattctctggctcagctacagaacncagcttctgacatcactgggctcgaggcgaagatgagctgactatactgtaacgtcccgggaangactagtacgtaactataattgtcgtacgtacggaacgtaacggaaccgaggtccaccgtacgtacgcgaccgacccgaacgacccaacccgtntcgttacctaaccgttccgtcccg

SEQ ID NO: 336224 - DNA, 550 bp, Homo sapiens
  misc_feature: GZ8MTXP01B3BPS.25.34.D01.1.454.CMB.2.raw
  modified_base (317)..(317): a, c, t, g, unknown or other
  misc_feature (317)..(317): n is a, c, g, or t
  modified_base (484)..(484): a, c, t, g, unknown or other
  misc_feature (484)..(484): n is a, c, g, or t
  modified_base (546)..(546): a, c, t, g, unknown or other
  misc_feature (546)..(546): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctaccaaactcataattttgagaccagtaagcggccctntggggtttctagtcgattcactggctccaagtctggcaacacggccctccctaacaatctctgggctcaggctgaagacgaggcttgtttattctgtcttgttgctatgtggactagaaaactagtttggtgcgtcgggcggaacgggaccctaagttcgaccgttnttaacgtcagcccaaggcctcgcccccgttggttccaacttctcgttccccacccttcctcnctcg

SEQ ID NO: 336225 - DNA, 519 bp, Homo sapiens
  misc_feature: GZ8MTXP01EM4D7.25.34.D01.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
tcagactgtacagtcacgaccggtgctcgatttagatcgtctgtggaggggggtcacaagaggcagcgctctcgggacgtctccaccatggcctgggctctgctgctcctcaccctccctcactcagggcacagggtcctgggcccagtctgccctgactcagcctgcctccgtgtctgggactcctggacagtcggtcaccatctcctgcactggaaccagccgtgacattggtncttataactntgtctctgtccaanacaccagcaaggccccaaatcatcattatgatgtcagtcatcggccctctggtacgtttctggtcgtccttctctggtctccaaagtctgggcaaacttcgggcctccctgaccatctcggggctccgagctgaggacgaggctacttattatgctagtttcatacagacacacaangtctggtgtcggnggaaggaccagtcgaccgtctcggttcgcgacccgaaggctccgcccctggttcctccttcgttccccg

SEQ ID NO: 336226 - DNA, 638 bp, Homo sapiens
  misc_feature: GZ8MTXP01EDP6T.25.34.D01.1.454.CMB.2.raw
  modified_base (209)..(209): a, c, t, g, unknown or other
  misc_feature (209)..(209): n is a, c, g, or t
  modified_base (459)..(459): a, c, t, g, unknown or other
  misc_feature (459)..(459): n is a, c, g, or t
tcagactgtacagtcacgaccggtgctcgatttagatcgtctgtgaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttgcttacttgaccttgtctcttggtaccaaacaacacccggacaaaggctaccaaactcataattttgagaccagtaagcggccctctgggggttttctagtcgattcactggctccaacgtctggcaacacggaccctaccctaacaatctctgggctccaggctgaagacgaggcttgtttatttctgtcttgttgctagtgtggactagaaaactagtttgggtncgttacgggcggaacgggtaccctaagttcggtaccgtacgtttaaacgtcgaaccggacccgaaacgggtccgttccccggttcccccccgttcgggttaccccgtaaccctttcccgttccccgggttttccccccgacccccgtttcccttaacccggttaacccttttaaccggg

SEQ ID NO: 336227 - DNA, 555 bp, Homo sapiens
  misc_feature: GZ8MTXP01D9SU4.25.34.D01.1.454.CMB.2.raw
  modified_base (208)..(208): a, c, t, g, unknown or other
  misc_feature (208)..(208): n is a, c, g, or t
  modified_base (414)..(414): a, c, t, g, unknown or other
  misc_feature (414)..(414): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctacttgaccttgtctcttggtaccaacaacacccggacaaaggctaccaaactcataattttgagaccagtaagcggccctcgtggggtttctagtcgattcactggctccaagtctggcaacacggaccctcctaacatctctggctcagctgagacgagcttgttattctgtctgttnctatgtggctagtaaaactatttggtgcgtcgggcggaacgggtaccctaaagttcgaccgttcttaaagtcaggccccaaaggtcctacggttcccccgttggttccaacttctcgttccccacccttcctcgaacttcg

SEQ ID NO: 336228 - DNA, 609 bp, Homo sapiens
  misc_feature: GZ8MTXP01ELITP.25.34.D01.1.454.CMB.2.raw
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacacggcccctgtacttgtcatctaataacggtaaaaacaccggccctacgaagggactaccccaagaccgtattctcctcggctaccgagcctaacaaggaacacacgtccttcctagaccatcacgtggggctcgaggacggaagagtgaggctagacttaagttacgtacggtaaaccggtcccgggaatagacctaaggtacgtaaacctattaaacgttagtcggttacttacggaaacgttggggaacccttaaagggtcccaccgtccgtaagggttcccacggaccccaacgggaccccaacccctacgtcgttaccctaaccgttccgttcccgg

SEQ ID NO: 336229 - DNA, 539 bp, Homo sapiens
  misc_feature: GZ8MTXP01CM0R5.25.34.D01.1.454.CMB.2.raw
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
  modified_base (534)..(534): a, c, t, g, unknown or other
  misc_feature (534)..(534): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctattgaccttgtctctggtaccaacaacaccgacaaagctaccaaactcataattttgagaccagtaagcggccctcgtggggtttctagtcgattcactcggctcaacgtctggcaacacggcctaccctaacaactctctgggctccgagctagaagacgaggctgtttattctgtctgttgctatgtggactagtaaaactatttggngcgtcgggnggaacggaccctaagttcgaccgtnttaagtcagcccaagcctcgccccgttgctaacgtctcgtccccgccttctcncttcg

SEQ ID NO: 336230 - DNA, 549 bp, Homo sapiens
  misc_feature: GZ8MTXP01C0AUY.25.34.D01.1.454.CMB.2.raw
  modified_base (216)..(216): a, c, t, g, unknown or other
  misc_feature (216)..(216): n is a, c, g, or t
  modified_base (310)..(310): a, c, t, g, unknown or other
  misc_feature (310)..(310): n is a, c, g, or t
  modified_base (449)..(449): a, c, t, g, unknown or other
  misc_feature (449)..(449): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggaccccggcagagggtctccatctcttgtctgggancagctccgacgtcggaaataagttgtctactggtaccagcagctcccagaaacggcccccaagctcctcatctataggaatgatcagcgccctnagggatacctgaccgattctctggctccgaagtctggcctcctcggccctcccgtggcccagtcaggtcgggctccgggtccgaggactggaggctaggaattattacgtgtgcgtaggtttgggattggcctagttcnggagtggtcccgtaggttgtcgggcgggagggaccaaggctgaccgtcaggtcacgcccgaggcctcgccccctggtccacgttcctcgttccccaaccc

SEQ ID NO: 336231 - DNA, 509 bp, Homo sapiens
  misc_feature: GZ8MTXP01BYJOD.25.34.D01.1.454.CMB.2.raw
  modified_base (227)..(227): a, c, t, g, unknown or other
  misc_feature (227)..(227): n is a, c, g, or t
  modified_base (354)..(354): a, c, t, g, unknown or other
  misc_feature (354)..(354): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctattatgcaagctggaccagcagaagccaggacacggcccctgtacttgcatctataggtaaaaacaccggccctcgagggactcccagaccgattctcctggctccagctacaaggaacncagccttcctgaccatcacgtggggctcgaggcgaagatgaggctgactattacgtgtaaccgtcccggganagacagtgaacataatntgtcttcggaatgggacaggtccacgtctggcncgcccaagcccaacccgntcgcctcttcgtccg

SEQ ID NO: 336232 - DNA, 621 bp, Homo sapiens
  misc_feature: GZ8MTXP01EZ7XX.25.34.D01.1.454.CMB.2.raw
  modified_base (220)..(220): a, c, t, g, unknown or other
  misc_feature (220)..(220): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtcgaaatagttgtctactggtaccagcagctcccagaaccggccccaagctctcatctatagaatgatcagcggccctgagggtactacctgaccgtattctcgtggctccggaagtctcggcctcccgtccgggccctcccgtaggcccatccgaggtcggggcctcccgggtccgaggagtcgagggcctaggtaaattactttacgtggtcgcgtagggtttagggatcggggcgtaggtctggaggttcggtccggtacgggtggttccggggcgggtacggggaccaaggccgtcggttacccggtccgttagggtccacggaccccgaacgggttcctcccggtcccccgtcgggtccaccgttcctccgttccccctaacccc

SEQ ID NO: 336233 - DNA, 656 bp, Homo sapiens
  misc_feature: GZ8MTXP01DXJ6C.25.34.D01.1.454.CMB.2.raw
  modified_base (535)..(535): a, c, t, g, unknown or other
  misc_feature (535)..(535): n is a, c, g, or t
  modified_base (563)..(563): a, c, t, g, unknown or other
  misc_feature (563)..(563): n is a, c, g, or t
  modified_base (632)..(632): a, c, t, g, unknown or other
  misc_feature (632)..(632): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtcggccttgggacagacagtcaggatcacatcgaccgaaaggacgacacgcctacgaagaacgtcttaattagtacgacaaagcgtacggtaccagacaaggaacgccgaaggaccgaccggtcccctagttacttgtactatacttaagtaaacggtaaaaaccgaccccggtccctacgaacgggacctacccgaacgtaccgtacttcctcccggtcgcctaccgagtaccctaaacgaaacggtaaccacgtacgttccctttcccgtacgaacctactccgacggttcgggctacggagggacgaagagtggagtctagtaacttagttacgtacgtaaccggccgganacgacgtacgtacgtaaactattaattntcgtccgtaacggacgtaacggaaccgagtccaccgtacgtacgccgacgaccccaacggccccaaccnctcgttcctaaccgttccgtcccg

SEQ ID NO: 336234 - DNA, 558 bp, Homo sapiens
  misc_feature: GZ8MTXP01E17KP.25.34.D01.1.454.CMB.2.raw
  modified_base (220)..(220): a, c, t, g, unknown or other
  misc_feature (220)..(220): n is a, c, g, or t
  modified_base (314)..(314): a, c, t, g, unknown or other
  misc_feature (314)..(314): n is a, c, g, or t
  modified_base (404)..(404): a, c, t, g, unknown or other
  misc_feature (404)..(404): n is a, c, g, or t
  modified_base (540)..(540): a, c, t, g, unknown or other
  misc_feature (540)..(540): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccgggcaggagggtctccatctcttgttctgggancagctccgacgtcggaaatagtttgtctactggtaccagcagctcccagaaaccggccccaagctcctcatctataggaatgatcagcgccctnagggatacctgaccgattctctggctcgaagtctggcctcccgtccggccctcccgtggcccatcgaggtcgggctcccgggtccgaggntggagctagaaatattacgtgtgctaggtttgggattcgggcctaggtctggaggtcgggtccggacggttggttcgggcgggacggaccaaggctggaccgtccgttaggccagcccgaggcctcgcccctggcncttctcgttccctaaccc

SEQ ID NO: 336235 - DNA, 557 bp, Homo sapiens
  misc_feature: GZ8MTXP01A4AZ8.25.34.D01.1.454.CMB.2.raw
  modified_base (239)..(239): a, c, t, g, unknown or other
  misc_feature (239)..(239): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaggacaggcccctgtactgtcatctaatggtaaaaacaccggcctacaggactcccagaccgattctcctggctcagctacaaggaacncagcttctgaccatcacgtggggctgaggcggaanatgaggctgacttatacgtgaaaccgtcccggggaanagacgtagtacgtaacagttaattagtcgtacgtacggaacgtaacggaaccgttaacggtcccaccgtaccgtacggaccgaccgaccccgaacggaccccaaccccgtctcgttacctaaccttccgtcccg

SEQ ID NO: 336236 - DNA, 639 bp, Homo sapiens
  misc_feature: GZ8MTXP01BJ9CG.25.34.D01.1.454.CMB.2.raw
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgtaagctggaccagcagaagccagacaggcccctgtacttgcatctaatacggtaaaaaccaccggccctacgagggactcccgagaccgattctcgtcgcctcagctacaaagaaacncacgtccttcctcgaccatcacgtggggctacggaggacggaagngtaggacggtctaggaacttagttacgtacgtaacccgtcccgggggaacacggacctaggtacgtaaacctaattaacttagttcgttaccgttacgggaaaccgtcgggggtaaaccctaacgggttcccctaaccggttccgtaacgggtacccaaccggaccccgaaaccggaacccccaaacccccgtaacgttccggtacccttaccgttcccgttcccggttccccccg

SEQ ID NO: 336237 - DNA, 637 bp, Homo sapiens
  misc_feature: GZ8MTXP01BXF7Y.25.34.D01.1.454.CMB.2.raw
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaagctattatgacaagctggtaccagcagaacgccgaggacacggcccctgtacttgtcatctatacggtaaaaccacccggcctacgagggactcccgacgaccgtattcctcctcggctccgagcctaacgaacggaacacacgtccttacctcgaccatccacggtggggcctcgagggacggaagacgtggacggctagtaaccttattaaccgtacggttaaccggtcccggggaacacggccgtaaggtacggtaaccaatttaaacttgtcgttacgttaccgggaacgttcgggggaacccaaggggttacccaccggtaccgtacgggttaccgaccgaccccgaacggacccccaaaccccgtacgtaccgttacctaacccgttcccgtttccccgg

SEQ ID NO: 336238 - DNA, 619 bp, Homo sapiens
  misc_feature: GZ8MTXP01BFST1.25.34.D01.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagcccaccctcagtgtcgtcgggaccccccgggnaggagggtctccatctcttgttctgggancagctccgacgtcggaaatagttgtctactggtaccagcagctccagaaaccggccccaagctcctcatcataggatgatcgagccggccctcagggactacccgtgaccgattctctggcctccggaagtctgggtcctcccgtcgggccctcccgtggcccatcgaggttcggggctcccgggtccgagggtactggacggtctagaaattagttacgtggtggcgtagggtttgggattggggccctaggttccgtaggtaggtcgggtccggtacgggtggttccgggcggggacgggaccgaaggctcggttaacccgtcgttaaggtccacggccccgaggccgttccggccccctgggtccaccgttccgtccgttaacccctccccg

SEQ ID NO: 336239 - DNA, 781 bp, Homo sapiens
  misc_feature: GZ8MTXP01EAA0Q.25.34.D01.1.454.CMB.2.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtcgtcggggaccccccgggnaggagggtctccatcttcttgttctgggancagctccgacgtacggaaattaagtttgtctactggtaccagcagcctcccgaagaaacccggccccaagcctcctcatctaataggaatgatcgacgccggcccctagacggggtactacccgtgaacccgtatttcctcgtcgggcctaccggaacgttcgtcgggcccttccccgtacccgggccccttcccgtacgggaccctaagtcccgtagggtccgggggtccttccccgggggtaccggagggacgttcgggaacggttcctaaggtaaaactttagtttaacgtggtacgtcgttaaggggttttgggaacgttcggggtacccgtaggttccgtaggtacggggttccggtccccggggttaaggggttcgggtttccgggggacggggaacggggtaacccgaaggtcccggttaacggaccccgggtttcgttaacgggtaccggaaccggacccccggttaagggttcccgtccccgggtccccccggttcgggttccccgtaacctttccccgttaacccggtttccccccctaacccccg

SEQ ID NO: 336240 - DNA, 735 bp, Homo sapiens
  misc_feature: GZ8MTXP01EJ760.25.34.D01.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagcccaccctcagtgtcgtcgggacccccggcaggagggtctccatctcttgttctgggancagctccgacgtacggaaattagtttgtctactggtaccagcagctacccaagaaaccggccccaagcctcncatctataggatgatcgagccgccctgagggtactaccctgaccgtattcctcgtacggtctaccgaacggttctcgggtcccttcccgtacccgggcccttccccggtgggacccctaagttccgacggggttcgggggccccgtttccccggggtcccggaagggtagtacgggacgggtaccttaggtaaaactttagtttaccgtgggttgacgttagggttttagggacgttcggggtcccgtaaggttcgtgggtaggttccgggggtacccgtacggggttcggttccggggcgggtaaggggaacccaagggtccgttcgggttaaccccggttccggttaacgggaccgtaccggaacccgttagggttccccgttcccggcccccgttccgggtaccctccgttcccgttcccgttcccccggtaaccccc

SEQ ID NO: 336241 - DNA, 690 bp, Homo sapiens
  misc_feature: GZ8MTXP01A14H4.25.34.D01.1.454.CMB.2.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcacgccaccctcagtgtcgtcgggaccccggnagaggtctccatctcttgtctgggancagctccgacgtacggaaattagttgtctactggtaccagcagctcccgaagaacccggccccaagcctccncatctanaggatgatcacgccgaccctgagggtacctacgtcgaccgtattcctcgtggcctacgaacgttcgtcggtcccttcccgtccggtcccctcccgtggaccctactccggacgggtccggggcccttacccggggtacccggtaggtaccggtgggacgggtccttaaggtaaactttacgttaacgtggttacgtaccgttagggtttagggtcgtacggggtcccgttaaggttccgtaagggtcgggttccggggttccgggacgggtttcgggtccgggggacggggaacggtaccgaacggtcgtacggttacccggtaccgttaggtccgacgttacccggacgccgtcccgtcccgtcgtcgtaccttccgtccgttccccgtccc

SEQ ID NO: 336242 - DNA, 573 bp, Homo sapiens
  misc_feature: GZ8MTXP01D9W6I.25.34.D01.1.454.CMB.2.raw
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggacccttntgtgtctgtggccttgggacagacagtcaggatcacatgaccaaggagacagcctnagaagctatangacaagctggaccagcagaagccaggacacggcccctgtacttgcatctatacgtaaaaacaccggcctgagggactcccagaccgattcnctcggcctcagctacgaaaggaaacncgacgtccttcctagaacccatcacgtggggactcgagggcgaagntagaggctagaacttagtactagtaacctcccgggggaanagacgtagtacgtaactattaagttagtcgtacgtacggaacgtcgggaactaacgttccaccgttacgtacggaccaccgcccgaaccgaaccccaacccgtctcgaccttacctccgttccgtaacccc

SEQ ID NO: 336243 - DNA, 588 bp, Homo sapiens
  misc_feature: GZ8MTXP01CD1B0.25.34.D01.1.454.CMB.2.raw
  modified_base (239)..(239): a, c, t, g, unknown or other
  misc_feature (239)..(239): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (561)..(561): a, c, t, g, unknown or other
  misc_feature (561)..(561): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaacgccgggacacggcccctctacttgtcttcgtacgtanaaacactcgcccctgagggactctcacgaccgattctccctcggctcccgcctacgaaacggaaaccncacgtcctttccttcgaccactcacgtggggcctcgacggcgacgaagagtcgaggctagactattacgtacgtaaccggtccggacacgcgagtacggtaaccaagttaattagtcgtacgttacggaacgtaacgggaaccttaggtccgacccgttcgtacggttaccgacgacccaacggtaccccaacccnctcgttacctaaccttcgttaaccccg

SEQ ID NO: 336244 - DNA, 527 bp, Homo sapiens
  misc_feature: GZ8MTXP01DUPK0.25.34.D01.1.454.CMB.2.raw
  modified_base (353)..(353): a, c, t, g, unknown or other
  misc_feature (353)..(353): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagcaggacaggcccctgtactgtcatctatagtaaaacaccggccctcgaggactcccagaccgattcctctcggctccagcctaacaaggaacncagtccttcctgaccatcacgtgggctcggggcgaagatggagctagactatacagtaaccgtccgggggacagcagtagtaaccataattatcgtcttacggaactgggaaccaaggttcaccgttcgtagtcagcccaggcccaaaccctgtcgcactcgttcgttcccccg

SEQ ID NO: 336245 - DNA, 567 bp, Homo sapiens
  misc_feature: GZ8MTXP01DGA6N.25.34.D01.1.454.CMB.2.raw
  modified_base (357)..(357): a, c, t, g, unknown or other
  misc_feature (357)..(357): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctaattatgcaagctggtaccagcagaagccaggacaggcccctgtactgcatctataggtaaaaacaccggccctacgagggactcccgagaccgattcctcctcggctccagctacaggaacncagcttctgacatcactgggctcgaggcgaaagatgaggctagactattacncgtaacgtcccgggatagacagtcgtaaccagttaaattntgttcttacgggaactcggggaaccttaagggtccacccggttacgtacggttaccgacggaccccgaaacgggaccccaaaccccgtactcggttacctaaccgttccgtttccccg

SEQ ID NO: 336246 - DNA, 542 bp, Homo sapiens
  misc_feature: GZ8MTXP01BSRYS.25.34.D01.1.454.CMB.2.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (447)..(447): a, c, t, g, unknown or other
  misc_feature (447)..(447): n is a, c, g, or t
  modified_base (479)..(479): a, c, t, g, unknown or other
  misc_feature (479)..(479): n is a, c, g, or t
  modified_base (515)..(515): a, c, t, g, unknown or other
  misc_feature (515)..(515): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacgtcaatcaccatttccngcactggaaccngcactgatgttgcttactttgaccttgtctcttggtaccaacaacacccggacaaaggctaccaaactcataattttgagaccagtaagcgccctntgggggtttctagtcgattcactggctcaagtctggcaacncggaccctccctaacaatctactgggctccaggctgaagacgaggcttgtttatttctgtctgtgctatgtggactaggaaactagtttggngcgtcgggcggaggtaccctaattcgaccgtnttaaagtcacgcccaaggcctcgccccttggttccnctctcgttcccaccttctcaacgttcg

SEQ ID NO: 336247 - DNA, 666 bp, Homo sapiens
  misc_feature: GZ8MTXP01D0M9X.25.34.D01.1.454.CMB.2.raw
  modified_base (398)..(398): a, c, t, g, unknown or other
  misc_feature (398)..(398): n is a, c, g, or t
tcagactgtacagtcacgaccggtgctcgatttagatcgtctgtgttgggtttgggggctcagaagcagagttctggggtgtctccaccatggcctggacccctctctggctcactctcctcactcttgcataggttctgtggtttcttctgagctgactcaggaccctgctgtgtctggtggccttggggacagacagtcaggatcacatgaccaaggagacagccctacgaagaagtcttaatatgacaagcgtaggaccagcaagaacgccgaaggacacggcccctagtacctgtacatacgtagtaacggaaaaccacccggcctacgaaggactacccgaaggtacctagttcctccgtcggtcctccgagtccgtaaaccgaacggaaccncgtaccgtacccttaccgtacgactacgtaccgacggtagggtacacggacgggacgaagtagtacggtacgtactagtacgttaacgttaccgtacggtaaccgggtacccggaatacgtacgtaacgttaacgtaacttaattaacgttcgttacgttaccgtacgggaacgtaacggtaaccgttacggtccgttaccgtacgtacggaccaaccggaccgaaccgtaccccaaccgtcgtccgttacctaaccgttccgtcccg

SEQ ID NO: 336248 - DNA, 553 bp, Homo sapiens
  misc_feature: GZ8MTXP01DZPUV.25.34.D01.1.454.CMB.2.raw
  modified_base (243)..(243): a, c, t, g, unknown or other
  misc_feature (243)..(243): n is a, c, g, or t
  modified_base (335)..(335): a, c, t, g, unknown or other
  misc_feature (335)..(335): n is a, c, g, or t
  modified_base (431)..(431): a, c, t, g, unknown or other
  misc_feature (431)..(431): n is a, c, g, or t
  modified_base (456)..(456): a, c, t, g, unknown or other
  misc_feature (456)..(456): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgccaaaggagacagcctcaagaagctaattangcaagctggtaccagcagaagccaaggacacggcccctgtactgtcatctatagtaaaaacaccggcctcaggactccagaccgattcctcnggctccagctacaaggaacacacgtccttcctagaccatcacgtgggctcgaggcgaagagtgagctagactattactcgtaacggtcccgggaanagacgagtagtaactaattaaattntcgttacgtacggacgtaacggaaccacggtccttaccgtacgtacgttaccgacgacccgaaccgacccaaccctctcgttacctccttccgtccg

SEQ ID NO: 336249 - DNA, 667 bp, Homo sapiens
  misc_feature: GZ8MTXP01CV33L.25.34.D01.1.454.CMB.2.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (619)..(619): a, c, t, g, unknown or other
  misc_feature (619)..(619): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaggagacagcctanaagaagcttattangacaagcgtaggtaccagcagaacgccaggacacggcccctgtactgtcatactaagtacggtaaaaaaccacccggccctacgaacgggactaccccgaacgtacccgtatttccgtcccgttcggacctccgaacgccgtaaaccgaaacgggaaccaccgtaacgtccctttaccctacggaaccctacgtaccgacggttcgggcctacggaggggacgaaagagtaggacggtctagtaaccttaatttaaccgtacggttaaaccggggtccccggggaaatacggtaacgtaagggtaacgtaaacctaagttaatttagtcgtaccgttacggaacgtaacggaacgttacggtaccgaccgttacnggttaccacgaccccgaacgacccaaccacgtcacctccgcgttcccg

SEQ ID NO: 336250 - DNA, 591 bp, Homo sapiens
  misc_feature: GZ8MTXP01DBG31.25.34.D01.1.454.CMB.2.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcaccatttccngcactggaaccagcactgatgttgtcttacttgaccttgtctcttggtacaacacaccgacaagcacaatcatatttnagacagtaagcgcctgtgggttctagtcattcactggctcaagtcaggcaacacgccctacctaacaatctcgcgggcctcgaggctagaagacgtaggctttagttttacttcgttgtctttggttagtcttaagttggtacggtcgttaaaggtaaaacttaagtttgggtagccgttcgggacgggaacggggtaccctaagttcgtaccgttacttaacgtcgagccccgttaaggcccttcgcccccgttggttacctaaccttcttcccgtacccctacccttcctccgaacgtttcg

SEQ ID NO: 336251 - DNA, 712 bp, Homo sapiens
  misc_feature: GZ8MTXP01CTGJR.25.34.D01.1.454.CMB.2.raw
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgaactgactcacggaccccgctgtgtctgtggccttgggacagacagtcaggatcacatgacaaaggagacagcctacaagtaaactttattangactactccgtggtaccagacgaaggaacgccgggacacggcccctcttacttcgtccttacgtacggtaacgaaaacccnccccgccccgtacgacggactccgtacgaccgtaccgtattcctcgtcggccctcccgacccctacgaaacggaaccacgacgtaccctttacccgttcgaaccctatacccgtacggtcgggggacctacggacggcgaacaaaggagtggacggtactagtaacttacgttaccgtccgttacccgacccggactaccgtaaggggttaacgtaaaccttaattaacgtttacgtcgttaccgttacggaaaccgttcgggaaacctaaggtaccctaaccgggtccgttaacggccgaaaccgcccgaaaaccggccccaaaccccttcgttaccgtaacctacccttccgttccccgttcccgccccttccgttctaaccg

SEQ ID NO: 336252 - DNA, 652 bp, Homo sapiens
  misc_feature: GZ8MTXP01BMSOH.25.34.D01.1.454.CMB.2.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (281)..(281): a, c, t, g, unknown or other
  misc_feature (281)..(281): n is a, c, g, or t
  modified_base (421)..(421): a, c, t, g, unknown or other
  misc_feature (421)..(421): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgtctgggancagctccgacgtcggaaataagtttgtctactggtaccagcagctccagaaccgccccagctcnatctatagatgatcagcgcctgagggatacctgaccgtattctctggctccgaagtcgtggcctccgtaccggccctcccgaggcccatccgaggttgggcctccggtccgaggactggaggctaggaaattatttacgnggttgcgttaagggtttgggattgggaccctaggttccttagggaaggttcgggtacccggtagggttcgggttaccgggccggggtacggggaaccctaacgggtccgttacggacccggtttcccgttaaaggtcccgaaccgggaccccgaagggttccccgttcccggcccccccgttaagggtttccccctacccgttcccggttcccggttaacccccgtccccg

SEQ ID NO: 336253 - DNA, 704 bp, Homo sapiens
  misc_feature: GZ8MTXP01DIW2X.25.34.D01.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (678)..(678): a, c, t, g, unknown or other
  misc_feature (678)..(678): n is a, c, g, or t
tcagactgtacagtcacgaccggtgctcgatttagatcgtctgtgttgggtttgggggctcagaagcagagttctgggggtgtctccaccatggcctggacccctctctggctcactctcctcactctttgcataggttctgtggtttcttctgagctgactcaggaccctgctgtgtctggtggccttgggacagacagtcaggatcacatgaccaaagganacagcctcaagaanctaattangacaagctaggaccagacaagaacgcgaaggacgacgcccctgtacttgtcatactaagtaacggtaaaaaccgaccgaccctacgaacgggactacccaagaccgtattcctccgtcggctaccgacgtacctaacgaaacggaacacgtacgttaccctttaccgtacgaacctacgtaccgtacgtcgggggtacctacgggagggaacggaaagtaaggtaggacggtacgtacggaaacttaacgttaaccgtaccgggtaaaccggggttacccccggggaaagtaacgtaacgtaaacggtaaccggtaaaccttaaattaaaccgtttagttacggttaccgttaacgggtaacggaaccgggttaaccgaacgggttaccaccgttaccgtagacccgacgaccccaacggaccccaacccgtntaccgccttaacccttcgttaacccc

SEQ ID NO: 336254 - DNA, 574 bp, Homo sapiens
  misc_feature: GZ8MTXP01BSH7A.25.34.D01.1.454.CMB.2.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (355)..(355): a, c, t, g, unknown or other
  misc_feature (355)..(355): n is a, c, g, or t
  modified_base (437)..(437): a, c, t, g, unknown or other
  misc_feature (437)..(437): n is a, c, g, or t
  modified_base (542)..(542): a, c, t, g, unknown or other
  misc_feature (542)..(542): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctnagaagctattangcaagctggtaccagcagaagccaaggacacggcccctgtactgtcatctatacggtaaaacaccggcctacgaggactcccagaccgattctctggctccagctaacaagaacnctaacttcctacgacatcacgtcgggctacgaggacgaagagtacgaggctagacttattacgtagtaacccgccggggganacggacaggtacgtaacctattaattatcgtacgttacggaacgtcgggaaacctaggttcctaccgttcgtacggtcaacgccccgaacggaaccccaaccccncgtcgtacccttacctccgttcccgtcccccg

SEQ ID NO: 336255 - DNA, 572 bp, Homo sapiens
  misc_feature: GZ8MTXP01EA9G8.25.34.D01.1.454.CMB.2.raw
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (527)..(527): a, c, t, g, unknown or other
  misc_feature (527)..(527): n is a, c, g, or t
  modified_base (549)..(549): a, c, t, g, unknown or other
  misc_feature (549)..(549): n is a, c, g, or t
tcagactgtacagtcacgaccggtgctcgatttagatcgtctgtgttgggtttgggggctcagaagcagagtttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagaagccaggacacggcccctgtacttgtacatactaagtacggtaaaaaaccacccggtccctagaacgggactaccccaagacccgatttccgacctcggcctaccagtcctaaccgaacggaaccacgaacggtcccttaccgttagaccctattccgacgtgggctcgaggacgaagatgagcagactatacncgtaacgtccggganagcagtacgaactattaatctgtactacggactaaggacttaaggtcaccgtcgtaggcncgaccccgaaggcccaaacccncgtgttaccaacgttccgtcccg

SEQ ID NO: 336256 - DNA, 594 bp, Homo sapiens
  misc_feature: GZ8MTXP01CSXMQ.25.34.D01.1.454.CMB.2.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggngacagcctcagaagctattangcaagctggtaccagcagagccaggacacggcccctgtactgtacatctagtacggtaaaaacacccggccctacgaaggactacccagaccgattcctctcggctccgagcctaacagaacncagtccttctagacatcacgtgggctcgagggcgaaaggngtacgagtctagtaactagttacgtacgtaaccggtccggaacacgtacgtaagtacgtaaactaagtaattacgtcgtacgtacggaacgtaacgggaaccgttaacggtccaccgttaccgtacggaccaaccgaccccgaaaccggacccctaaccccgtgtaccgttacctaaccgttccgttaacccg

SEQ ID NO: 336257 - DNA, 574 bp, Homo sapiens
  misc_feature: GZ8MTXP01BTY6X.25.34.D01.1.454.CMB.2.raw
  modified_base (220)..(220): a, c, t, g, unknown or other
  misc_feature (220)..(220): n is a, c, g, or t
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
  modified_base (549)..(549): a, c, t, g, unknown or other
  misc_feature (549)..(549): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctcagaagctattatgcaagctggtaccagcaagacgcaggacacggcccctntactgtcatctaagtacgtaaaaccaccggcctacgaggactccagacgattcncctggctcagctaacgaacgaacncagtccttcctagaccatccacgtcggggctacgaggacggaagatcggaagtctagacttaattaacgtcgtaaccggtccgggacagacgaggtacgtaaacctattaaattcgtcgttaccgtacgggaactcggggaaccagggttccaccgtcgtaggttccgacgcccgaacggccccaaccccgtntacgttacctaaccttcgttccccg

SEQ ID NO: 336258 - DNA, 515 bp, Homo sapiens
  misc_feature: GZ8MTXP01CBQUM.25.34.D01.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
  modified_base (482)..(482): a, c, t, g, unknown or other
  misc_feature (482)..(482): n is a, c, g, or t
tcagactgtacagtcacgaccggtgctcgatttagatcgtctgtgaggggggtcacaagaggcagcgctctcgggacgtctccaccatggcctgggctctgctgctcctcaccctcctcactcagggcacagggtcctgggcccagtctgccctgactcagcctgcctccgtgtctgggactcctggacagtcggtcaccatctcctgcactggaacccagccgtgacattggtncttataactntgtctcctggtcccaacaacacccaggcaacggcccccaaactcatcatttangatgtcagtcatcggcctctggatttcnggtcgccttctctggtctccaaagtctggcaactcggcctcctgaccatcgtcgggctccgaggctgaggtacgnggtctacttattatgctagtttcatacaganacacanagtctggtgtcggnggaaggaacttaggtcacgtccgtcgttcncgaccaagctcgcccctgctaacgttcgtcccg

SEQ ID NO: 336259 - DNA, 631 bp, Homo sapiens
  misc_feature: GZ8MTXP01CDIIX.25.34.D01.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (465)..(465): a, c, t, g, unknown or other
  misc_feature (465)..(465): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaanctattangacaagctggtaccagcagagccaggacacggcccctgtacttgcatctagtacggtaaaaccacccggccctagaacgggactccccgagaccgtattcctcctcggctccgagtcctaacgaacggaacacgacgtcctttcctacgaccctataccgacgttcggggcctacgagggacggaagagtgaggctagacttaattacgtacgtaaccggtccgganagactaggtacgtaacctagttaacttgtcgttacgtacggaaaccgtcgggtaaccttacgggtacccacccggttaccgtaacgggttacccgaaccgttaccccgaaacggtaccccccaaacccgtcgttacggttaccctaaccgttcccgtttcccccgg

SEQ ID NO: 336260 - DNA, 664 bp, Homo sapiens
  misc_feature: GZ8MTXP01CXG6X.25.34.D01.1.454.CMB.2.raw
  modified_base (210)..(210): a, c, t, g, unknown or other
  misc_feature (210)..(210): n is a, c, g, or t
  modified_base (370)..(370): a, c, t, g, unknown or other
  misc_feature (370)..(370): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctacttgaccttgtctcttggtaccaacaacacccggacaaagctaccaaactcataattttgagacagtaagcgcctgtggggttctagtcgattcactggctccaagtctggcaacacggaccctaccctaanaactctcgtacggggcctccgaggctagaaagaccgaaggtcttaggtttacttctggtcttgttgctatgtagacgttaagtaaaacttaaagtttgggtacgtcgttccggggacggtaaaccgggggtacccctaaaagtttcggaacccgtttaacgtttaaaggttaccgaaacggtaccccgaaaagggtcccgtaacccggttccccccccgtttcggggttacccttaacccgtttcctccggttttccccccggccccttcccttaacccttaaccgtttcccgg

SEQ ID NO: 336261 - DNA, 784 bp, Homo sapiens
  misc_feature: GZ8MTXP01EUH7O.25.34.D01.1.454.CMB.2.raw
  modified_base (239)..(239): a, c, t, g, unknown or other
  misc_feature (239)..(239): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaagctattangcaagctggtaccagcagaagccaaggacacggcccctgtacttgtcatctatacggtaaaaacaccggccctacgagggactccccaagaccgtattcctcctcggctccgagtcctaacgaacggaaccacagtccctttaccttagaaccccattacccgaacggttcggggggcccttacggaacgggggaccggaaaaggtacgttagggaaacggggtcccttagggaaacctttaaacgtttaaacccggttaccggtttaaaaccccggggttaccccccgggggtaaaacgtaaccggtaaccggttaaacggtttaaacccggttaaaaacccttaaagttttaaaagtttacgttaccgggtttaacccgtttaaccggggaaaccggttaacgggggtaaacccgttaaacggggttacccttaaaccccggtttacccggtaacgggttacccgaaacccgggttaccccgaaacccggaccccctaaaccccgtacgttaccgttacccctaacccgtttccccgttcccg

SEQ ID NO: 336262 - DNA, 767 bp, Homo sapiens
  misc_feature: GZ8MTXP01B0W1Y.25.34.D01.1.454.CMB.2.raw
  modified_base (219)..(219): a, c, t, g, unknown or other
  misc_feature (219)..(219): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaagctattatgcaagctggtaccagcaagaagccaggacacggcccctgtacttgtcatctaatacggtaaaaaccacccggtccctacgacgggactccccgaagaccgtatttcctacccgtcgggcctacccgacggtacctaaccgaaacgggaaaccacgtaacgtccctttacccttacgaaccctactcccgaacgtcgggggactacggagggaccggaagtagtggaacgggtctaggtaaccttaacgttaaccgtacgggttaaacccgggtacccccggggaagtaaccgggtacgtaaacgggttaccggttaaaacccctaagtttaaaacgtttagttacggtttacccggtttaaccggggaaaccgtttaaccgggggaaacccgttaaacggggttaccccgttaaacccgggttacccgttaaacggggttaccccgaaaccgggacccccgaaaacgggtaccccccaaaccccgtacccgtacggttaccctaaccccgtttccgtttccccccggg

SEQ ID NO: 336263 - DNA, 619 bp, Homo sapiens
  misc_feature: GZ8MTXP01C6VMV.25.34.D01.1.454.CMB.2.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (481)..(481): a, c, t, g, unknown or other
  misc_feature (481)..(481): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaanctaattangacaagctggtaccagcaagaagccaaggacacggcccctgtactgtacatctaagtaacggtaaaaaccacccggaccctacgaacgggactacccgagacccgtattcctccgtcggcctcgacgtcctaacgaaggaaccactacgtcctttacctacgaaccatcgacgtggggcctcgaaggcggaaagagtggacggctagacttattaacgtcgtaaccggtccccgggaanacgacgtagtaacgtaaactaattaacttacgtacgttaccgtacggaacggtaacggaaccgttacggtaccgaccgttacgtacgaccgaccgacccgaaccgaccctaacctactcgttacctccgttccgtccg

SEQ ID NO: 336264 - DNA, 787 bp, Homo sapiens
  misc_feature: GZ8MTXP01ETCSE.25.34.D01.1.454.CMB.2.raw
  modified_base (246)..(246): a, c, t, g, unknown or other
  misc_feature (246)..(246): n is a, c, g, or t
  modified_base (371)..(371): a, c, t, g, unknown or other
  misc_feature (371)..(371): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagaagtcttaattangacaagcgtaggtaccagcagaagccgaggacacggcccctgtactgtcatactaataacggtaaaaaccaccggccctacgaacggactacccacgaccgtacttctcccgtcggtctccgacncctaacaacggaaccaacctaaacctttcccttacgaaccctactaccgaacggttcgggggacctaccggaaggggaccggaaagaagttacgggacggtacgtacggtaacttaacgtttaaccgttaacgggttaaaccccggttaccccggggggaactaacgggtaaccgtaaacgggttaaccggggttaaaacccctaaaacgtttaaacgttttaaagttacggtttacccgttttaaccgggaaacccgggtttaacggggaaacccggtaaaccgggttaccgtaccccggttaacccgttaacgggtaccccgaaccggttacccccgaaaccggggaaccccctaaaaccccctaacgttacccggtacccttacccgttccccgtttcccggtttcccccccg

SEQ ID NO: 336265 - DNA, 570 bp, Homo sapiens
  misc_feature: GZ8MTXP01CH5WP.25.34.D01.1.454.CMB.2.raw
  modified_base (239)..(239): a, c, t, g, unknown or other
  misc_feature (239)..(239): n is a, c, g, or t
  modified_base (363)..(363): a, c, t, g, unknown or other
  misc_feature (363)..(363): n is a, c, g, or t
  modified_base (547)..(547): a, c, t, g, unknown or other
  misc_feature (547)..(547): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcagggccctgctgtgtctgtggccttgggacagacagtcaggatcacatgaccaaggagacagcctcagaagctatangcaagctggaccagcagaagcaggacaggcccctgtacttgtcatctaatacggtaaaaacaccggccctacgaacgggactcccgaagacccgattcctcctggctccagctacgaaggaacncagccttctcgacatcacgtggggctcgaggcggaagatggaggctgacttaagttactagtaaccggtcccgggatagctagtacgtaaccattaattagtcgttacgttcggaacgttcgggaaccttaagggtccacccgttccgtaggttccgacgccccgaaacggccccaaaccccgntcgacctaaccgttccgttcccg

SEQ ID NO: 336266 - DNA, 557 bp, Homo sapiens
  misc_feature: GZ8MTXP01EGI6Y.25.34.D01.1.454.CMB.2.raw
  modified_base (208)..(208): a, c, t, g, unknown or other
  misc_feature (208)..(208): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (451)..(451): a, c, t, g, unknown or other
  misc_feature (451)..(451): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcaccatttccngcactggaaccagcactgatgttggcttacttgaccctttgtctcttggtaccaacaacaccganaagctacaactcataatttganacagtaagcgcctgtgggtttctagtcgattcactggctccaagtctaggcaacaccggtaccctaccctaacaactctcgtcgggctccgagggctagaagacgaggtcttgtttatttctgtcttgttgctatgtgactagaaaactatttggngcgtcgggaggaagggaccctaagtttcgaccgttcttaaagtcagccccaaagggcctcgccccttggttccaactcctcgttccccaccttcctcaacttaacg

SEQ ID NO: 336267 - DNA, 618 bp, Homo sapiens
  misc_feature: GZ8MTXP01EJAIG.25.34.D01.1.454.CMB.2.raw
  modified_base (243)..(243): a, c, t, g, unknown or other
  misc_feature (243)..(243): n is a, c, g, or t
  modified_base (474)..(474): a, c, t, g, unknown or other
  misc_feature (474)..(474): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaagctaattangacaagctggtaaccagcaagaacgccaaggacacggcccctgtacttgcatctaacgtacggtaaaaaccacccggccctacgagggactcccgaacgaccgtattctccgtcggcctaccgagacctaacgaaagaacacacgtccttacctacgacctatccgacgtggggactacggaggacggaagacgtaggacgctagactattacgtacgtaccggtccgganacgcaagtacgtaacattaaacttgtcgttacgtacggtaacgtaacgggaaccgttaaacggtccgttaacccgtacgtacggttacgaccggaccccgaacggaccccaacccgtactcgacctaaccgttccgttaacccg

SEQ ID NO: 336268 - DNA, 615 bp, Homo sapiens
  misc_feature: GZ8MTXP01DIA93.25.34.D01.1.454.CMB.2.raw
  modified_base (340)..(340): a, c, t, g, unknown or other
  misc_feature (340)..(340): n is a, c, g, or t
  modified_base (460)..(460): a, c, t, g, unknown or other
  misc_feature (460)..(460): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaagctattatgcaagctggtaccagcagaagccaggacacggcccctgtacttgctatactaagtaacggtaaaaacacccggccctacgaagggactacccagaccgnttctcgtggctacacgctaacgaagaaccacacgtccttcctacgacctatccacgtcgggctacgagggacgaagagtgagtctagacttaattactacggtaaccggtacccgggtanaacgccgaaggttacgtaaacctaagttaaattacttcggttaccgttacgggaaacggttaacgggaaccgttacggttaccgaccgtaccgtaggttaccgacgacccgaacggaccccaacccgtatcgttacctaaccgttccgttccccg

SEQ ID NO: 336269 - DNA, 740 bp, Homo sapiens
  misc_feature: GZ8MTXP01BKTKT.25.34.D01.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (396)..(396): a, c, t, g, unknown or other
  misc_feature (396)..(396): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttctctgagctgactcaggaccctgctgtgtctgtggccttgggacagacagtcaggatcacatgaccaaaggagacagcctanaagaagtcttaattagngacaagcgtaggtaccagcaagaacgccgaaggacacggcccctagtacttgtacatactaagtaacggtaaaaaaccacccggtaccctacgaacgggactacccgacgaccgtattcctcgcggtctccagcctaacgaacggtaacncgaaacgtcccttaccttacgaaccctagttaccgaaccggttcgggggtacctacggaaacggggaccggtaaaagagttaacgggacggtaccgtaacggtaaaccttaacgttaacgttaaccgggtaaacccggttaccccggggaacgtaaggtacccgtaaggttaaccggtaaaacctagtttaaacttagtacgttaccggtttaacggaaccggttaacgggaaacccgttaacgggttccttaaacccggttaccgtaacggttaccgcggaacccccgtaaacggacccccgaaacccctgtacggttacctaacccgttccttaacccccgg

SEQ ID NO: 336270 - DNA, 684 bp, Homo sapiens
  misc_feature: GZ8MTXP01BE09T.25.34.D01.1.454.CMB.2.raw
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgacaagctggtacccagacagaacgccaaggacacgcccctgtactgacatctataacggtaaaaacaccggcctacgaggactacccgagaccattctaccgcggtctaccagctaacgaaaggaaccacgtacgtccttaccctagaccctataccgacggtcgggtactaccggaagggtaccggaaagtacgtaggacggtctacggtaacttaacgttacgtaccggttaaccggtcccggggtaaacacggtacccgtaaggttaacgttaaaccctaagtttaaacgtttacgttacgtaccgtttaccgggaaacgttaacggggaaacccttaaggggttacccttacccggttaccgtaacgggttccaaccggaccccgaaacggcccctaaaccccgtactccgttacccgtaacctttaacccgttccccgg

SEQ ID NO: 336271 - DNA, 599 bp, Homo sapiens
  misc_feature: GZ8MTXP01EMBI3.25.34.D01.1.454.CMB.2.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
  modified_base (455)..(455): a, c, t, g, unknown or other
  misc_feature (455)..(455): n is a, c, g, or t
  modified_base (491)..(491): a, c, t, g, unknown or other
  misc_feature (491)..(491): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcatgatgttgcttacttgaccttgtctcttggtaccaacaacaccgacaaggctacaactcataattttganacagtaagcgcctgtgggttctagtcgtattcactggctcctaagtctaggcaacaccgacctaccctaacaatctcgtgggcctcgaggctagaagacgagggtcttagtttatttctgtcttgttgcttatggtgacgttagaaaactaagttttggngtcgtcggacggtacgggacctaagttcgaccgttnttaacgtcgacggacccgttaaacggcctccgggttcccccttcggggttacctaacccggttcgttcccgttccccctaccccttaccgtccttaaccggttaaccg

SEQ ID NO: 336272 - DNA, 724 bp, Homo sapiens
  misc_feature: GZ8MTXP01EMNV9.25.34.D01.1.454.CMB.2.raw
  modified_base (209)..(209): a, c, t, g, unknown or other
  misc_feature (209)..(209): n is a, c, g, or t
  modified_base (473)..(473): a, c, t, g, unknown or other
  misc_feature (473)..(473): n is a, c, g, or t
  modified_base (515)..(515): a, c, t, g, unknown or other
  misc_feature (515)..(515): n is a, c, g, or t
tcagactgtacagtcacgaccggtgctcgatttagatcgtctgtgaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcacctatttccngcactggaaccagcactgatgtggcttactttgaccttgtctcttcggtaccaacaacgacccggaacaaggcctaccaaactctaattaattttagaacgacctagtaaggcccggtaccttcgttggggtttctacgtcgtattcactggcctacgaacgtctgacaacgaccggtaccctacccgtaacaactcgtacgtcgggcctccgaggtcctagaaacgacgtaggtctttgttttactttcgtgttcttgttcgngttagtggtaggtactaaggtaaaacgttattttggggtacnccggtcggggacggtaaccgggtaccctaaggttccgtaacccggttacgtttaaacggtccgttaacgggaccccgttaaacgggtcccgttccccgggttacccccccgtttcggggttaaccccttccccgtttacccggtttccccgttttaccccccccgtaacccccgtttccccttaacccgttaacccggttttaacccgg

SEQ ID NO: 336273 - DNA, 629 bp, Homo sapiens
  misc_feature: GZ8MTXP01C988C.25.34.D01.1.454.CMB.2.raw
  modified_base (510)..(510): a, c, t, g, unknown or other
  misc_feature (510)..(510): n is a, c, g, or t
  modified_base (532)..(532): a, c, t, g, unknown or other
  misc_feature (532)..(532): n is a, c, g, or t
  modified_base (566)..(566): a, c, t, g, unknown or other
  misc_feature (566)..(566): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggacacagcctacgaagaaagtcttaattagtgacaagcgtacggtaaccagaccaagaacgccgaaggaccgacggtcccctagttactttgactattacgtagtaacggtaaaaaaccacccggaccctacgaacgggacctaccccgagtacccgtattcctccgtcggctaccgacgacctaaacgaacggtaaccactacgtccttacctacgacctatccgacgtggggcctacggacgggacggaagagtggagtcgtagactaattacgtacgtaccgtccgganacgcgagtacgaactataattntgttcgtacggaacgtcgggaaccttaggtaccncgtacgttcgaccgacgacccaacggaccccaaccgtctcgttacctaacgttcttaaccccg

SEQ ID NO: 336274 - DNA, 691 bp, Homo sapiens
  misc_feature: GZ8MTXP01A73D8.25.34.D01.1.454.CMB.2.raw
  modified_base (209)..(209): a, c, t, g, unknown or other
  misc_feature (209)..(209): n is a, c, g, or t
  modified_base (356)..(356): a, c, t, g, unknown or other
  misc_feature (356)..(356): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacctatttccngcactggaaccagcactgatgttggcttacttgacctttgtctcttggtaaccaacaacaccggaacaaggctaccaactctataatttgagacagtaagcgtccctgtgggtttctagtcgattcactgctacaagtctagcaacnccggaccctaccctaacaactctctcggctcgaggctagaaacgacgaggtcttaggtttatttccgtgtccttggttcgtacttaagttggtaggtaccgttaagtaaaaacgttaagtttcgggtcgtccgttcggggacggtaaaccggggtaccctaaacgtttacgtaacccggttattaaacggtaccgttaacggtaccccgttaaacggtccccgttcccggttcccccccggtttcgggttacccctaacccgggtttccctttaacccccggtttacccccctaaccccggttaccccttaacccgttaacccggtttaacccgg

SEQ ID NO: 336275 - DNA, 572 bp, Homo sapiens
  misc_feature: GZ8MTXP01B1ED0.25.34.D01.1.454.CMB.2.raw
  modified_base (275)..(275): a, c, t, g, unknown or other
  misc_feature (275)..(275): n is a, c, g, or t
  modified_base (529)..(529): a, c, t, g, unknown or other
  misc_feature (529)..(529): n is a, c, g, or t
tcagactgtacagtcacgaccggtgctcgatttagatcgtctgtgttgggtttgggggctcagaagcagagttctggggtgtctccaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaggcggccaggcccctntattgataatatatctggactctaagcggcccctgagggactcccctgagcgattctcgtggcctccccagcgcgagggaccaaaacgtgtcactattcgaccctatcaagtttgggacgttccagtcccgtaggagggacgaagggtctagaccttattactgtacagttacgaggtaacgaccgacccaaccactacctcgaccgtcggcgttcggcgggacggaaccaagcgtcgaccgtccgtggttccncgcccgaaggcctccgccccctcggttcctccgttcgtccccg

SEQ ID NO: 336276 - DNA, 634 bp, Homo sapiens
  misc_feature: GZ8MTXP01APBHJ.25.34.D01.1.454.CMB.2.raw
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (420)..(420): a, c, t, g, unknown or other
  misc_feature (420)..(420): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacggtcaatcacctatttccngcactggaaccagcactgatgttgcttacttgaccttgtctcttaggtacaacaacaccgganaagctacaaactctattaatttgagacagtaacgcgtcctgtggggttctagtcgattcactggctcacgtctgcaacncgccctacctaanactctcgtcggctcgagctagacgacgaggtcttgtttatttcgtgtcttggttncttagtgttggaacgttagtaaaaacgttagtttcgggtacgtccgttcggggacggtaaccggggaaccccttaaggtttcggtaacccgttcgttaaacgtcgaccgggacccgttaaacgggtccttcccggttcccccgttcgggttcctaacccgttcccggttcccgttacccccctaccccttccctaacccgttaacgtttcccgg

SEQ ID NO: 336277 - DNA, 565 bp, Homo sapiens
  misc_feature: GZ8MTXP01A6M4K.25.34.D01.1.454.CMB.2.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
  modified_base (396)..(396): a, c, t, g, unknown or other
  misc_feature (396)..(396): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctcgtgtctgggtctccgtggacgtcaatcaccatttccngcactggaaccngcactgatgttgctattgaccttgtctctgtacaacacaccganaagctcaactcatatttganacagtagcgcctcgtgggtttctagtcgattcactggctcaacgtctggcaacacggccctaccctaanaactctactgggctccgagctgaagacgaggtctgtttattcgngtctgtgctatgtgcgtagaaactagtttgagcgtcgggacggagggtaccctaagttccgaccgttagttaacgtcaacggtacccgaaaggcccgtaccgcccccgttggttaccccaacgttcccttaacggttcccccacccttcctaaccgttaaccgttaacg

SEQ ID NO: 336278 - DNA, 809 bp, Homo sapiens
  misc_feature: GZ8MTXP01DELF2.25.34.D01.1.454.CMB.2.raw
  modified_base (225)..(225): a, c, t, g, unknown or other
  misc_feature (225)..(225): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatcgaccgaaaggganacagcctacgaagtaaacgtcttaattatgacaaaggtcgttacgggaacccaaggcaaacggaacgaccgaacggaaccgaccggtacccccttaggttaccttgtactaagtactaacgtaaacggtaaaaaccgaccccggtcctacgaacgggtacctacccgaaggacctaacttcctacccgtcggtacctaccgacgtccgtaaacgaaacggaaaccctacgtaacgttacccttaccgttaccgaacccgtagtacccgaacgggttcgggggtaacctacgggaacgggaacggggaaacgtaagggttacggaacggtaccgttaacgtaaccgttaaacgttaaccggttaaccgggtaaacccggggttaccccgggggaaataaccggtacggtaaacgggttaaaccgtaaaacccttaagttttaaaaccgttagttacccggttacgtaaccgggaacggttaacgggtaaaccggttaacggtacccgttaccggttacgtacggttaccgacgttaaccccgaacgacccctaaccgtctacgttcctaaccgttccgttccccg

SEQ ID NO: 336279 - DNA, 726 bp, Homo sapiens
  misc_feature: GZ8MTXP01A0SNU.25.34.D01.1.454.CMB.2.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctnaagaagtcttaattangacaagctaggaccagcaagacgcaggcacggccctgtactgtcatcgtaagtaacggtaaaaacccacccggccctaggaacggtacctccccgaagtacccgtattccgtcccgtggcctaccacgtcctaacgaaacggaaccaccgtacgtccctttacccgtacgaaccctagtacccgaacggttcgggggacctaccgggaaggggaaccggaaagtagtacggaacggtcttacgtaaacgttaacgttacgttaccgtaaaccgggggtcccgggaacacggtaccgtaaagggttaaccgttaaacctaagtttaaacgttagttaccggttaccgttaacgggaaaccggttaacggggaaacccttaaacgggttccccaaccgggttacgtacggttaccgaccggaacccccgtaacggcccccaaacccggtctaccggttaccctaacccgttcccgtttccccgg

SEQ ID NO: 336280 - DNA, 679 bp, Homo sapiens
  misc_feature: GZ8MTXP01B0W5Y.25.34.D01.1.454.CMB.2.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
  modified_base (452)..(452): a, c, t, g, unknown or other
  misc_feature (452)..(452): n is a, c, g, or t
tcagactgtacagtcacgaccggtgctcgatttagatcgtctgtgttgggtttggggagagaagacaggattcaggacaatctccagcatggccggcctccctctcctcctcaccctcctcaatcactgtgcagggtcctgggcccagtctgtgctgactcacgccaccctcagtgtcgtcggggacccccggnaggacggtctcatctcttgtcgtgggancagctccgagtacggtaaattagtttgtactacgtggtaccagcacgcctacccagaaaccgccccaagctcanatcagagatgatcagccgcctagaggactaccgagaccgtattccgtacgtcggaccttacccgaacggttctcggacccctaccgtcccaccggtccccttcccgagggtcccagtccggtacggggtccgggggtaccacgttcgtaggacggngtacggagtccgttagtactttaacgttcgcgcgacgtaacggcggtaggtagggtatccgaacgttcgccgttagtaaggtttcgggttgggtttacggggtttacgggacgggtaacggggaacgttaaggtcccggttccggtaaccggttcgttacgggttcgacccgggaaccggtaaccgtccgtaccccgtccccggttcggtaaccttccgtttccccg

SEQ ID NO: 336281 - DNA, 599 bp, Homo sapiens
  misc_feature: GZ8MTXP01AH34B.25.34.D01.1.454.CMB.2.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagactgtacagtcacgaccggtgctcgatttagatcgtctgtgaggggggggtcacaagaggcagcgctctcgggacgtctccaccatggcctgggctctgctgctcctcactctcctcactcaggacacagggtcctgggcccagtctggcctgactcaacctgcctccgtgtctgggtctcgtggacggtcaatcacctatttcctgcactggaaccagcactgatgttgcttacttgaccttgtctcttggtacaacacaccgacaagctcaactnattaatttganacagtaagcgccttcgtgggttctagtcgtattcacgtggctaccgaacgtctaggactaaccacggtaccctacccgtaactaactctcgttacgggcctccgaggcctagaacgcggaagcgttgtttagtttcctggtcttcgttgctagtggtggacttagaaaacgttagttgggtgcggtcgggacggtaacgggtaccctaagtttaccgaccgttataacgtcgacggacccgttaacgggtcctaccggccccgttcggttcctaacgtcctcgttccccacccttcctcaacgttcg

SEQ ID NO: 336282 - DNA, 619 bp, Homo sapiens
  misc_feature: GZ8MTXP01CGCAQ.25.34.D01.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (238)..(239): a, c, t, g, unknown or other
  misc_feature (238)..(239): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggacctgctgtgtctgtggccttggacagacagtcaggatcacatgaccaagganacagcctanagaanctattanncaagctagacagcaagaacgcaaggacacggtcccctgtacctgacatacctaagtaacgtaaaaaccaccggcctagaggactccaagaccgtatcncgtcggctacgacncaaacgaagggtaacacgaactccttacctagaacttaaccacgtacgtcggacacggaaggacggaatacgtacgacgacgtacgtacgtaacgtacgtaacgtaaccgggtaccggtaacgacgtacgtaacgtaacgtaacgtaagttaagttacgtacgtacgtacgtaacggtaacggtaacggttaacgtacgttaccgtacgtacgttacgaccgacccgaaccgacccgaacccacctaccgttacctccgttccgtccg

SEQ ID NO: 336283 - DNA, 719 bp, Homo sapiens
  misc_feature: GZ8MTXP01ETZFY.25.34.D01.1.454.CMB.2.raw
  modified_base (489)..(489): a, c, t, g, unknown or other
  misc_feature (489)..(489): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtggccttgggacagacagtcaggactcacatcgaccaaaggacgaacacgcctagaagtaacgtcttaattagacgacgaaacggtcgttaacgggaaccacgacgaaacggaacgaccgaacggtaccgaccggtaccccttagttacttgtacctattaacgtaaacgtaaacggtaaaaacccgaccccggtaccgtacggaacggtacctacccgtaacgtaccgtacgttccgtcccgtacggtcctaccgagtacccgtaaacgaaccggaactacgtaccgttcccttaccgtacgtaacncgtacgtacggtacgggacacgggagggaacggagtaggtacggacggtctaacgtaacttacgttacggtaaccgaccggggtacggactacggtacttaagtacgtaactttataacgttgtaccgttacgtacggaacgtaacggaaccgttcggtcccgttacgtcggtacgacggccaccgaacccgacctaaccgtactccgttacctccttccgttaaccccg

SEQ ID NO: 336284 - DNA, 606 bp, Homo sapiens
  misc_feature: GZ8MTXP01AWDE8.25.34.D01.1.454.CMB.2.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
tcagactgtacagtcacgaccggtgctcgatttagatcgtctgtgaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcacctatttccngcactggaaccagcactgatgttgctacttgaccttgtctcttgtaccaacaacaccgacaagctacaactcatatttganacagtaagcgcctcgtgggtttctagtcgtattcactggtctccaagtctaggaccaacaccggacccttacccgtaactaaactcgtccgtcggggccttcccgagggtcctagaaaggtacgaggtcttaggtttactttcgtcgtcttgttgcttagtcgttgacttagtaaaactagttgggtgcgtcgggacggtaacggaccctaagttcgtaccgtcgttaagtcgagacccgttaaggtcctaccggcccccgttcggttacctaaccttccgtccgttccccgcccttcctcgttaaccgtttaacg

SEQ ID NO: 336285 - DNA, 517 bp, Homo sapiens
  misc_feature: GZ8MTXP01EOLUX.25.34.D01.1.454.CMB.2.raw
  modified_base (344)..(344): a, c, t, g, unknown or other
  misc_feature (344)..(344): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
  modified_base (494)..(494): a, c, t, g, unknown or other
  misc_feature (494)..(494): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagagccaggacaggcccctgtactgcatctatagtaaaaacaccggcctcaggactcccagaccgattctctggctccagctacagaacncaaactcctagaccatcacgtgggctcgaggcgaagatgagctgactatacngtaactccggggganagcagtgaaaccagtaattatgtctacggaactgggaaccaaaggttcaccgttcgtacggtcacgcccaaggcccaaacccncttacgcactcgttcgtcccccg

SEQ ID NO: 336286 - DNA, 643 bp, Homo sapiens
  misc_feature: GZ8MTXP01ESU63.25.34.D01.1.454.CMB.2.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (504)..(504): a, c, t, g, unknown or other
  misc_feature (504)..(504): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggttttcttctgagctgactcaggaccctgctgtgtctgtggccttgggacagacagtcagatcacatgccaaggagacagcctacaagaancttattangacaagctaggtaccagcaagaacgccaggaccacggccccttagtacttgtacatactaagtacgaaaacccgaccccgggccctacgaacgggactaccccgaagacccgtagttcctcccgtcggacctaccgagccctaacgaaacggtaaccactaaaccttccttacgacctactacgacggttcggggctacgggaggacggaagagtacgggagactacgtaacttacttacgtacgtaccggtacccgggggnacggtacagtaacgttaaactaattaagttcgtacgttacgtacggaacggtacggaaccgtaacggttccaccgttcgtacgcaaccggcccaaccgaaccccactaacgtccgtcttaccttcccgttcccgtcccc

SEQ ID NO: 336287 - DNA, 529 bp, Homo sapiens
  misc_feature: GZ8MTXP01C04CF.25.34.D01.1.454.CMB.2.raw
  modified_base (464)..(464): a, c, t, g, unknown or other
  misc_feature (464)..(464): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (511)..(529): a, c, t, g, unknown or other
  misc_feature (511)..(529): n is a, c, g, or t
tcagactgtacagtcacgaccggtgctcgatttagatcgtctgtgttgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgattatttgactggttattagtggggggcctactactactactacatggacgtcgtggggacaaagggacccacggtcacccgtctccctcacgcctacccaccgaacgggccccacgtccggtcccctttccccctcggcccacccccttccctaccgaaacgacgccaccgtccggtccgggggccacgacggcccggccccgtcgggctcggccgtcgggtacgaaggacctaccgttccacgtcgtacncggtctgggaaggccgggcgtcggacgaacgggccganagtaggngnnnnnnnnnnnnnnnnnnn

SEQ ID NO: 336288 - DNA, 775 bp, Homo sapiens
  misc_feature: GZ8MTXP01DA6PM.25.34.D01.1.454.CMB.2.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (367)..(367): a, c, t, g, unknown or other
  misc_feature (367)..(367): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggttttcttctgagctgactcaggaccctgctgtgtctggtggccttgggacagacagtcaggatcacatcgaccaaggacgacagcctanaagaagtcttattatnacgaagctaggtaccagacaacgaacgccgaaggaccgacggtaccccctagttacttgactactacgtaagtaaacggtaaaaccacccggcctacgacggactaccgagtaccgtntctaccgtcggactcgagcctaaacgaacggaacacgacgtacccttactacgaccctatacccggacgttcggggacctacgggaacggaacggtaacgaacgttggaccgtagttaacgaactttaacgttaaccgttaaccggtaaacccgggggttaccccggggaaataaccggtaccggtaaacgttaaccggtaaacctaatttaaacgtttagttaccgggtttaccggttaacggtaaacggttaacgggaaacccgttaaccgggtacccgttaaccgggtttaacctaacggggttaaccccaacgggaaaacccctaaaaccccggggaaacccccttaaaccccgggtccgttaccgttaccccgtttaacccgttccccttttaacccccccgg

SEQ ID NO: 336289 - DNA, 642 bp, Homo sapiens
  misc_feature: GZ8MTXP01AXLQ8.25.34.D01.1.454.CMB.2.raw
  modified_base (208)..(208): a, c, t, g, unknown or other
  misc_feature (208)..(208): n is a, c, g, or t
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
  modified_base (631)..(631): a, c, t, g, unknown or other
  misc_feature (631)..(631): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctcgtgtctggtctcctggacgtcaatcacctatttccngcacgtggaaccagcactgatgttggtcttactttgaccttgtctcttaggtaccaacaaccgacccggaacaacggcctaccaaactctaattaattttagaacaccgaagtaacggcggtacccttcgttagggggtttactacgttacgtacttcgactggaccttcgtaaacgttccgtacggtacccaacacccggtaaccctaccctaacgaactcctacgtcgggctaccgaggactaggaagacgaggtctttagtttattcngtctgttgntagtgttacggactaagtaaaacttgttggtacgtcgtacgggacggaacgggtaccctaaagttcgtacggttacttaacgcgacgtccacgtctccgccccgttaggttcctaacgttcctccttccccacccttaccttnaaccgttaacg

SEQ ID NO: 336290 - DNA, 755 bp, Homo sapiens
  misc_feature: GZ8MTXP01EJ0SZ.25.34.D01.1.454.CMB.2.raw
  modified_base (244)..(244): a, c, t, g, unknown or other
  misc_feature (244)..(244): n is a, c, g, or t
  modified_base (427)..(427): a, c, t, g, unknown or other
  misc_feature (427)..(427): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatcgaccaaggagacagcctacaagaagctattangacaagctaggtaaccagacaagaacgccgaaggacacggcccctgtactgctatctaataacggtaaaaaccacccggcctacgacggacctacccgagtaccgtattcctacccgtcggacctaccgacgtacctaaacgaaacggaaccaccgtacgtacccttaccctacgaaccctanccgtaacggtcggggcctacggagggtaccggaaagtacggtaggaacggtcgtaacgtaaccttaacgttaaccgtaacggtaaacccggggtacccggggtaacgtaacggtaccgtaaagggttaccggttaaaaccctaagtttaaacgtttacgttacggttaccgtttaaaccggggtaaacggtaaccgggggtaaacccgttaacggtttacccgaacccggttaccggttaacggaccccgttacggaaccccccgtaaccggaaccccctaaaccccggttcctacggttacccctaacccgtttcccgttcccccgg

SEQ ID NO: 336291 - DNA, 474 bp, Homo sapiens
  misc_feature: GZ8MTXP01BOWX1.25.34.D01.1.454.CMB.2.raw
  modified_base (464)..(474): a, c, t, g, unknown or other
  misc_feature (464)..(474): n is a, c, g, or t
tcagactgtacagtcacgaccggtgctcgatttagatcgtctgtgttgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgattatttgactggttattagtggggggcctactactactactacatggacgtcgtggggacaaagggaccacggtcaccgtctcctcacgccctccaccgaacgggcccatccggtccttccccctcggccacccctcctaccaagacgccacctcgtcgggggcacgagccggcccgtggggcctcggccctgggacaacggactactccgactgtacagtctgacgcgggctggacaaggccgagatagnnnnnnnnnnn

SEQ ID NO: 336292 - DNA, 700 bp, Homo sapiens
  misc_feature: GZ8MTXP01B17TY.25.34.D01.1.454.CMB.2.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttctctgagctgactcaggaccctgctgtgtctggtggccttgggacagacagtcaggatcaacatgaccgaaggacgacagcctanaagaatctattagngacagcgtacgaccagacaagacgcgaagacgacgccctagtactgtacactactaacgtaaacggaaaaaccacccggcctaacgacggtaccacccgacgtaccgtacttacgtcccgtcggtacaccgaacgtaccgtaaacgaaacggaaccacgtaccgttcctttacccgtactaacccgtactacccgtacgggtaccgggactaccgggagggacggtaaagagttacgggatacgtagtaaacttaacgttaacgtaccggttaccggacccggaagtacgaacggtaacgtaagtaaaccttagtaaactttcgtacggtacttaacgggaacgttaacggggaaccttaacgggtacccgttaaccgtaccggttaagcccgaaccgaaccccggaaccggaccccaaaccggttctccgttaacctccttaaccgttccccg

SEQ ID NO: 336293 - DNA, 631 bp, Homo sapiens
  misc_feature: GZ8MTXP01E2SXT.25.34.D01.1.454.CMB.2.raw
  modified_base (367)..(367): a, c, t, g, unknown or other
  misc_feature (367)..(367): n is a, c, g, or t
  modified_base (531)..(531): a, c, t, g, unknown or other
  misc_feature (531)..(531): n is a, c, g, or t
  modified_base (625)..(625): a, c, t, g, unknown or other
  misc_feature (625)..(625): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcaacatgaccaaggagaacagcctacaagtaactttattatgcactcctacggtaccagacaagaacggccggacaccgccctactacgttcgtcttacgtaacggtaacaaaacccgcccccgtcccctagaacgggtactcccgtacgaacgtacccgtnttcgtccgcggtacccctcccggcctaagaacggaaaccaaccgtacgtcccgtttacctacgaaccctacgtccgacgggtcggggccacggaggcccagaagtagcgaaggtctagtacttattaccgtcgttaccccgaccgggacaacgtggtaggtaancgtaggttgtaggtcgtcgggagtacggacgtaggtcgccgttcgtacgcacggtccagttccttccgcccctgaacctcgtcttccgtccccnccgtcc

SEQ ID NO: 336294 - DNA, 651 bp, Homo sapiens
  misc_feature: GZ8MTXP01A9Y22.25.34.D01.1.454.CMB.2.raw
  modified_base (245)..(245): a, c, t, g, unknown or other
  misc_feature (245)..(245): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatcgaccaaggagacagcctcaagaagtcttattangacgaagcgtaggtaccagacaaggaacgcgaacggacgaccggtcccctgttacttgtacactactaacgtaacggtaaaaaccgacccggtacccgtacggaacggtacctacccgaacgaccgtacttcctccgtacggtcctaccgacgtaccgtaaacgaaacggaaccacgtaaccgtccctttaccgtacgaccctacgtccgtacggtcgggaccgtacggacgggacggaagtagtacggacggtactacgtaacttacgttacgtaacggtaccgggtaccggactacgacgtagtacgtaactattaactgtcgtacgtacgcgtaacggacttagtccacgtagacgcgcgacccgtaaccgaccctaacgctcgacctaacgttccgtaaccc

SEQ ID NO: 336295 - DNA, 759 bp, Homo sapiens
  misc_feature: GZ8MTXP01BEXF8.25.34.D01.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgttggttttcttctgagctgactcaggaccctgctgtgtctgtggccttgggacagacagtcaggatcacatgaccgaaagganaacacgccctanaagaacgtcttaattancgacaacgtcgtacggtaccagacagaacgccgaacggaccgaccggtcccctgttaacttgtacaacgtactaagtaacggtaaaaaaccgaccccggccctacgaaccgggtaacctaccccgaaggaacccgtatttccgtccgttccgggtctacccgtacggaccgttaaacccgaaacggtaaacctaccgaaccgttccctttaccttacgaccctacgtaccgtacgggttacgggggaccctacggggagggtaaccgggaaacggttaaggacggtaaccgggtctaacggttaaaccttaaccggtttaacgtaccggtaacccgggggtacccgggtacctaaggtaccccgtaaggtttaacgtaaacttaatttaaagttacgtcgttacgttaccgggaaactcggaaacgttaccgtaccgttccgtacgttacggaccgccgaacccgaacgaccctaaccacgtcttacctaaccgttccgttaaccc

SEQ ID NO: 336296 - DNA, 548 bp, Homo sapiens
  misc_feature: GZ8MTXP01CDYI7.25.34.D01.1.454.CMB.2.raw
  modified_base (267)..(267): a, c, t, g, unknown or other
  misc_feature (267)..(267): n is a, c, g, or t
tcagactgtacagtcacgaccggtgctcgatttagatcgtctgtgaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttgctacttgaccttgtctctgtacaacaacaccganaagctacaactcataattttgagtaccagtaagcggccctgtgggtttctagtcgattcactggctcaacgtctggcaaaccacggaccctaccctaacaaatctctagggcctcgaggctgaagacgaggcttgtttatttctgtctgttgctatgtggctagaaaactatttggtagccgtggcgggaagggaccctaaagttcgaccgtcttaaaggtcagcccaaaggcctcgccccgttcgttcaacctcgtccttcccacccttcctcaacgtcg

SEQ ID NO: 336297 - DNA, 688 bp, Homo sapiens
  misc_feature: GZ8MTXP01CN678.25.34.D01.1.454.CMB.2.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (381)..(381): a, c, t, g, unknown or other
  misc_feature (381)..(381): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccacctcagtgtcgtcggggacccccggnagagggtctccatctcttgtctgggancagctccgacgtcggaaatagttgtctactggtaccagcagctccaagaaccggccccaagctcctcatctatagaatgatcagccggccctgagggatacctggaccgtattctcgtggctaccgaagttctcgggtcctcccgtaccgggcccttcccgngggcccagttccgaggtcggggcctcccgggtccgaggtactcggaaggcttaggaaacttagttacgtggtacggtcgtaaggtttaggggaattcggggaccctaggtccgtagggtacggtcgggtccggtacgggttcggttcggggcgggtaacggggtacccgaaaggtccgttaacgggaaccccggttccgttaaacggggtcccgaacggttccccggttaaacggccccggtaacccggtcccccccggtaagggttccctaacccttccggttaacccggttccccctaacccccg

SEQ ID NO: 336298 - DNA, 763 bp, Homo sapiens
  misc_feature: GZ8MTXP01CJN0S.25.34.D01.1.454.CMB.2.raw
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcacggaccctgctgtgtctggtggccttgggacagacagtcaggatcaacagtgaccgaaagggacgaccaggccctacgaagaagtcttattatgacaagcgtaggtaccagcaagaacgccgaggaccacggcccctgtacttgtactatacgtaagtaacgggtaaaaccaccccggtcccgtacgaacggtactaccccaaggtaccctacttcttcccgtacggctacccgacgaccgtaaccgaacggtaaccacgtacgtccctttccctagaccctatacccgtacggtcggggacctacgggacgggtaaccggaaggtagttacggggacgtaccgtaagtaccgttaaacgtttacggttaaccggtaccccggggtacccggggaacgtacggtaccggtaacggttaaaccggtaaccttaaagtttaacgttacgttaccgggttaccgtttaaccgggaaacccggtaacgggaacccgtttaaacgggtcccgttaaccccgggtaacgtcggttaccgttaccggaaccccgtaacccggtacccctaaaccgtctcggttaccctccgtttcccgtaacccccg

SEQ ID NO: 336299 - DNA, 555 bp, Homo sapiens
  misc_feature: GZ8MTXP02GMGOG.25.34.D01.1.454.CMB.2.raw
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
tcagactgtacagtcacgaccggtgctcgatttagatcgtctgtgagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaancggccctctggggtttctagtcgattcactggctccaagtctgcaacacggcctcctacaatctctgggctccaggctgaaagacgagctgttatttcngtntgtntntatgtgatagtaaataagttagtgtcgtcggacggacggacgtaacgtacgtacgtacgttaacgtacgacgaccgacgacgtccgtccccgtccgtaccgtaaccgtcctccgttccctacccctaccctacctactacg

SEQ ID NO: 336300 - DNA, 519 bp, Homo sapiens
  misc_feature: GZ8MTXP02IIPM4.25.34.D01.1.454.CMB.2.raw
  modified_base (206)..(206): a, c, t, g, unknown or other
  misc_feature (206)..(206): n is a, c, g, or t
  modified_base (367)..(367): a, c, t, g, unknown or other
  misc_feature (367)..(367): n is a, c, g, or t
  modified_base (437)..(437): a, c, t, g, unknown or other
  misc_feature (437)..(437): n is a, c, g, or t
  modified_base (499)..(499): a, c, t, g, unknown or other
  misc_feature (499)..(499): n is a, c, g, or t
tcagactgtacagtcacgaccggtgctcgatttagatcgtctgtgagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggcttacttgaccttgtctcttggtaccaacaacacccggacaaaggctccaaactcataattttgagaccagtaagcggccctctggggtttctagtcgattcactggctccaagtctggcaacacggcctccctanaatctctggctcaggctgagacgagctgtttatttctgctgttgctatgtggctagaaaactatttggtncgtggcggagggacccaattgacgtcttaagtcagcccaaaggctcgccccctgcaacgtcncgttcccacctcctcactcg

SEQ ID NO: 336301 - DNA, 524 bp, Homo sapiens
  misc_feature: GZ8MTXP02GN224.25.34.D01.1.454.CMB.2.raw
  modified_base (296)..(296): a, c, t, g, unknown or other
  misc_feature (296)..(296): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
tcagactgtacagtcacgaccggtgctcgatttagatcgtctgtgaggggggtcacaagaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttataactatgtctcctggtcccaacaacacccaggcaaggcccccaaatcatcatttangatgtcagtcatcggccctctggagtttctggtcgcttcctctggctccaagtctggcaactcggcctcctgaccatcgtcggggctcccgaggctgaggacgaggcttacgttattattgactatttcattacagagacaccaanagtctggtgttcggnggagggaccaaggttgaccgtctcggtcacgcccaaggctcgccccgtcggtccactctcgttcccc

SEQ ID NO: 336302 - DNA, 537 bp, Homo sapiens
  misc_feature: GZ8MTXP02F6HOS.25.34.D01.1.454.CMB.2.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (449)..(449): a, c, t, g, unknown or other
  misc_feature (449)..(449): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctacactggactcagcactgatgttgcaggttattactttgtctcctggtaccaacaacacccaggcaaacgcccccaaacttatcatttangagccactaagcgcctnaggagtttctaatcgcttctctggcctccaagtctggcagcacggcctccctgaccaatctctgggctccaggctgaggacgaggctagatttatactgactactcatatggaacacatcaactaaactcccgtnttaccgaccgtgggaacctagggtccaccggtccgtgggtccacgcccaaacggcccaaacccgactcgtccactcctcgttaccccc

SEQ ID NO: 336303 - DNA, 518 bp, Homo sapiens
  misc_feature: GZ8MTXP02HW0SG.25.34.D01.1.454.CMB.2.raw
  modified_base (329)..(329): a, c, t, g, unknown or other
  misc_feature (329)..(329): n is a, c, g, or t
  modified_base (446)..(446): a, c, t, g, unknown or other
  misc_feature (446)..(446): n is a, c, g, or t
tcagactgtacagtcacgaccggtgctcgatttagatcgtctgtgttggatttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagaagccaggacaggcccctgtactgtcatctataggtaaaaacaccggccctacaggactcccagaccgattccnctgctccagcctcaggaaacacagccttcctgaccatcacgtggggctcgaggcgaagactgaggctagactattactgtaacctcccgggacagcaagtggtaaaccataacttangtacttacggaactgggaaccaaaggtcaaccgtctaaggtcacgcccaaggcccaacccatcgtacacgtc

SEQ ID NO: 336304 - DNA, 552 bp, Homo sapiens
  misc_feature: GZ8MTXP02HNHGV.25.34.D01.1.454.CMB.2.raw
  modified_base (101)..(101): a, c, t, g, unknown or other
  misc_feature (101)..(101): n is a, c, g, or t
  modified_base (542)..(542): a, c, t, g, unknown or other
  misc_feature (542)..(542): n is a, c, g, or t
tcagactgtacagtcacgaccggtgctcgatttagatcgtctgtgttgggtttgggggctcagaagcagagttctggggtgtctccaccatggcctggacncctctctggctcactctcctcactctttgcataggttctgtggtttcttctgagctgactcaggaccctgctgtgtctgtggccttgggacagacagtcaggatcacatgccaaggagacagcctcagaagctatatgcaagctggtaccagcagaagccaggacaggcccctgtactgtcatctataggtaaaacaccggccctagagggactcccagaccgatcctctgctccagcctcaggaaacacagtccttaccttacactcacgtggcgtcaggacggaagagtaggacggacgtgtacgtaacttaacgtacgtaaaccgttacccggtacgaagaccgagtagtaaccgtaataagttatagtcgttacgaacgtaggaccgaagtacgaccgtacgtacgtcgaccacgaaccgacgaacccactcgtacncctactcccg

SEQ ID NO: 336305 - DNA, 531 bp, Homo sapiens
  misc_feature: GZ8MTXP02F3WZ8.25.34.D01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (350)..(350): a, c, t, g, unknown or other
  misc_feature (350)..(350): n is a, c, g, or t
  modified_base (466)..(466): a, c, t, g, unknown or other
  misc_feature (466)..(466): n is a, c, g, or t
  modified_base (515)..(515): a, c, t, g, unknown or other
  misc_feature (515)..(515): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaattagtttgtctactggtaccagcagctcccagaaaccggccccaagctcctcatctatagaatgatcagcggccctgagggactaccctgaccgtattctctggctcgaagtcnggcctcctccggcctcccgtggcccatccgagtcgggcctcccgggtccgaggatggaggctgaatattactgtgactggtttgggatgccagtctgagtcggtcgaggtgtcggnggagggaccagctgaccgtcgaggtcacgccaaggcctcgcccctggcncgtctcgtccctaccc

SEQ ID NO: 336306 - DNA, 513 bp, Homo sapiens
  misc_feature: GZ8MTXP02JC3VW.25.34.D01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgagtcggaaatagttgctactggtaccagcagctcccagaaacggccccaagctcctcatctataggaatgatcagcggccctnagggataccctgaccgattctctggctcgaagtcnggctctcggcctccctgccatcagtgggctccggtccgaggatgaggctgaatnttacngtgctagtttgggatgcagtctgagtggtcgacggtgtcggcggaggaccaagctgaccgtccgtaggtcacgcccgaaggctcgcccctggtcactctcgtcccgtccc

SEQ ID NO: 336307 - DNA, 514 bp, Homo sapiens
  misc_feature: GZ8MTXP02I307J.25.34.D01.1.454.CMB.2.raw
  modified_base (354)..(354): a, c, t, g, unknown or other
  misc_feature (354)..(354): n is a, c, g, or t
  modified_base (430)..(430): a, c, t, g, unknown or other
  misc_feature (430)..(430): n is a, c, g, or t
tcagactgtacagtcacgaccggtgctcgatttagatcgtctgtgagggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctctggggtttctagtcgattcactggctccaagtctgcaacncgcctcctacatctctggctccaggctgaagacgagctgtttattcgtgctgttgctatgtgctgaaacatttggnctggcgagggaccaagttgacgtcttaagtcagcccaaggctacgccccctggtccaacgtctcgttcccaccttcctcactcg

SEQ ID NO: 336308 - DNA, 530 bp, Homo sapiens
  misc_feature: GZ8MTXP02H71LN.25.34.D01.1.454.CMB.2.raw
  modified_base (314)..(314): a, c, t, g, unknown or other
  misc_feature (314)..(314): n is a, c, g, or t
  modified_base (441)..(441): a, c, t, g, unknown or other
  misc_feature (441)..(441): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacacaccggacaaaggctccaaactcataaattttgagaccagtaagcggccctntggggtttctagtcgattcactggctccaagtctggcagcacggcctcctgacaatctctgggctccagctgaggacgaggctgattattactgctactcatatggtacacatacacaaatcccgtnttcggacctgggaccagggtcaccgtctcgggtcacgcccaaacggcccaaaccccgaactcgtaccactcctcgttcccgcccttccc

SEQ ID NO: 336309 - DNA, 530 bp, Homo sapiens
  misc_feature: GZ8MTXP02HADCZ.25.34.D01.1.454.CMB.2.raw
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (517)..(517): a, c, t, g, unknown or other
  misc_feature (517)..(517): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctaccaaactcataattttganaccagtaagcgccctctggggtttcagtcgattcactggctcaagtctgcaacncgcctccctacaatctctggctcaggctgaagacgagctgtttatttctgctgtgctatgtggctgtaaaactatttggtgctcgggacggtacgggacccaagttcgacgttcttaacgtcagcccaaaggcctcgccccctggtccaacgtctcggtcccncctcctcacttcg

SEQ ID NO: 336310 - DNA, 526 bp, Homo sapiens
  misc_feature: GZ8MTXP02G56S5.25.34.D01.1.454.CMB.2.raw
  modified_base (315)..(315): a, c, t, g, unknown or other
  misc_feature (315)..(315): n is a, c, g, or t
  modified_base (466)..(466): a, c, t, g, unknown or other
  misc_feature (466)..(466): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctacttgaccttgtctcttggtaccaacaacacccggacaaaggctaccaaactcataattttgagaccagtaagcggccctntggggtttctagtcgattcactggctcaagtctggcaacacggcctccctacaatctctggctcgagctgaagcgagctgtttattctgctgttgctatgtggctagaaaactatttgggtagcgtcggcggagggacccaattgaccgtnttaaacgtcagcccaaggctcgccccctggtcaacgtctcgttcccacctcctcacttcg

SEQ ID NO: 336311 - DNA, 603 bp, Homo sapiens
  misc_feature: GZ8MTXP02GD41V.25.34.D01.1.454.CMB.2.raw
  modified_base (239)..(239): a, c, t, g, unknown or other
  misc_feature (239)..(239): n is a, c, g, or t
  modified_base (365)..(365): a, c, t, g, unknown or other
  misc_feature (365)..(365): n is a, c, g, or t
  modified_base (461)..(461): a, c, t, g, unknown or other
  misc_feature (461)..(461): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggaccagcagaagccaggacacggcccctgtactgcatctaatacggtaaaaaccacccggccctacgaggactcccgaagaccgattcaccgtcgcctccagcctacgaacggaaccncaacgtccttaccttgaaccctagtccaacgtcggggacctacgagggacggaagagtgagctagacttattaccgtgtaaacccgtcccgggaanacggacgtaacggtaacgtaaactagttaagttacgtacggttaccgttaacggaacgtacgggaaccgtacggtccgtaacccgtacgtacgaccgaccgacccgaacgaccccaaccgtctacgtacctacttccgtccg

SEQ ID NO: 336312 - DNA, 560 bp, Homo sapiens
  misc_feature: GZ8MTXP02F0IW2.25.34.D01.1.454.CMB.2.raw
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcgcctctggggttcagtcgattcactgctcaagtctgcaacncgcctcctacatctctggctccagctgaanacgaggctgttattcngctgtgctatgtggctagaaaactagtttgggtgcgttcgggcgggaacggggaacccctaagttcgaaccgttacttaaacggttccaaggtccccaaagggcctccggtccccctgggtccaacgttccttcgttaccccctacccttcctacctacttccgg

SEQ ID NO: 336313 - DNA, 572 bp, Homo sapiens
  misc_feature: GZ8MTXP02JREJ8.25.34.D01.1.454.CMB.2.raw
  modified_base (208)..(208): a, c, t, g, unknown or other
  misc_feature (208)..(208): n is a, c, g, or t
  modified_base (314)..(314): a, c, t, g, unknown or other
  misc_feature (314)..(314): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacaccggacaaaggctccaaactcataattttgagacagtaagcggccctntgggtttctagtcgattcactggctcaagtctggcaacacggcctacctacaactctctgtctccaggctgaagacgagctgtttattctgcttgtgctatgtggctagaaaactaagtttggtgcgttcggacgggtagggacccctaaagttcgaaccgtcgtttaacgtacagaccccgaaaggccgttaccgcccccgtcggtaccaaccgttccttaccggttcccccaacccgttcccttaccctacgtacg

SEQ ID NO: 336314 - DNA, 545 bp, Homo sapiens
  misc_feature: GZ8MTXP02JGA55.25.34.D01.1.454.CMB.2.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctattangcaagctggtaccagcagaagccaggacaggcccctgtactgcatctataggtaaaaacaccggccctagagggactccccaagaccgattcncctggctccagctacaaggaacncagccttcctagacccatcacgtggggctacgagggcgtaagatgaaggctgactattacngtaaaccncccggganagcgaagtacgtaaacattaatntgttacgtacggaacgtacggaccaggtccaccgtacgtacgccaacgacccgaacggaccccaaacccgtctacgtacctaccgtcctcg

SEQ ID NO: 336315 - DNA, 514 bp, Homo sapiens
  misc_feature: GZ8MTXP02G4IS8.25.34.D01.1.454.CMB.2.raw
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (415)..(415): a, c, t, g, unknown or other
  misc_feature (415)..(415): n is a, c, g, or t
  modified_base (442)..(442): a, c, t, g, unknown or other
  misc_feature (442)..(442): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccggacacggcccctntacttgtcttctacggtagaaaacactcgcccctnagggatctcagaccgattcncctgcctcgctcagaacncancttctgaccatcactgggctcgagcgcaagatgaggctagactatactagtaacctcccggganacgacagtacgtaaaccagtaatagtntacttacggaactacgggacaaggtcacgtctaggtcacgacccaaggccaaccccactcgacactctaccg

SEQ ID NO: 336316 - DNA, 550 bp, Homo sapiens
  misc_feature: GZ8MTXP02IHCZF.25.34.D01.1.454.CMB.2.raw
  modified_base (315)..(315): a, c, t, g, unknown or other
  misc_feature (315)..(315): n is a, c, g, or t
tcagactgtacagtcacgaccggtgctcgatttagatcgtctgtggaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaagctaccaaactcataattttgagaccagtaagcgccctntggggtttctagtcgattcactggctcaagtctggcaacacggcctacctaacaatctctcgggcctcaggctagaaagacgaggctgttatttctgtctgtgctatgtggctagaaaactatttgggtgcgtcggacgggaagggaccctaaagttcgaccgtacttaaaaggtcagacccaaaggctccgccccctcggtcaaccgtctacttccccaaccttccactacctg

SEQ ID NO: 336317 - DNA, 571 bp, Homo sapiens
  misc_feature: GZ8MTXP02F7FFZ.25.34.D01.1.454.CMB.2.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (422)..(422): a, c, t, g, unknown or other
  misc_feature (422)..(422): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctataggtaaaaacaccggccctgagggactcccagaccgattcncctggctcagctcagacncagcttctgaccatcacgtggggctcggggcgaagatggaggctagactattactaggtaaacctcccggggaanagactaggtacgtaaacctattaagttagtcgttacgttacggaacgtacgggaacctaacggtcctaaccggttacgtacggtaccgaaccggacccgaaacggaaccccaaaccctcgtacgtacctacgttccgtaccgttccccg

SEQ ID NO: 336318 - DNA, 657 bp, Homo sapiens
  misc_feature: GZ8MTXP02GSSSI.25.34.D01.1.454.CMB.2.raw
  modified_base (312)..(312): a, c, t, g, unknown or other
  misc_feature (312)..(312): n is a, c, g, or t
  modified_base (475)..(475): a, c, t, g, unknown or other
  misc_feature (475)..(475): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaagctattatgacaagctggtaccagcagaagccaggacacggcccctgtactgtcatctataggtaaaacaccggcctanaggactcccagaccgattctccgtgcctccagcctacaaggaaccacagtccttacctgaacctatccaacgtggggacctcgaagggacggaaagagtagggacgggtacctaggtaaaccttaagttaaccgtacggttaaacccgtcccccgggggaaanacggtacgtaacggttaaccggtaaaacctaagtttaaattacgttacgttaccgttaacgggtaacgtacggggtaaccctaaacgggtaccctaaccggttaccgtaacggtaccaaccggaccccgaaaccggtacccccaaaccccgtacgtaccgtacctacccgttccgtaccccg

SEQ ID NO: 336319 - DNA, 537 bp, Homo sapiens
  misc_feature: GZ8MTXP02GVV3Y.25.34.D01.1.454.CMB.2.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
tcagactgtacagtcacgaccggtgctcgatttagatcgtctgtggaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacaccggacaaggctacaaactcataattttganaccagtaagcggcctctgggtttctagtcgattcactggctcaagtctgcaacacggcctcctacaatctctggctcagctgaagacgagctgttattctgctgtgctatgtgctagaaaactagtttggtgcgttcggcgggacggacccaaagtttcgaacgtactttaaacgctagcccgaaaggcctcgccccctcggtcaaccgtctcgttccccaccctcctacctacttaccg

SEQ ID NO: 336320 - DNA, 524 bp, Homo sapiens
  misc_feature: GZ8MTXP02I8D90.25.34.D01.1.454.CMB.2.raw
  modified_base (181)..(181): a, c, t, g, unknown or other
  misc_feature (181)..(181): n is a, c, g, or t
  modified_base (209)..(209): a, c, t, g, unknown or other
  misc_feature (209)..(209): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (395)..(395): a, c, t, g, unknown or other
  misc_feature (395)..(395): n is a, c, g, or t
  modified_base (449)..(449): a, c, t, g, unknown or other
  misc_feature (449)..(449): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagtgtctgggacccccgggnagagggtctccatctcttgttctgggancagctccgagtcggaaatagtttgctatggtaccagcagctccagaacgccccaagctctnatcatagaatgatcagcgcctnaggactaccngaccgattctctggctcgaagtctggccctccgtcggccctcccgtggcccatccgagtcgggcctccgggtccgaggatgaggctagaaatnttactgtgtcgtaggtttgggatcgcctagtctgacgtggtccgaggtgtcggnggacggacagcgtgaccgtcgtaggtcagcccgaagcctcgcccctggcaacgtctcgtcccacctctacactcg

SEQ ID NO: 336321 - DNA, 579 bp, Homo sapiens
  misc_feature: GZ8MTXP02I07YV.25.34.D01.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaattagttgtctactggtaccagcagctccagaacgccccaagctcctcatctataggatgatcagcgcctgaggatacctgaccgtattctctggctcgaagtctggctccgtccggcctcccgtggccatccgaggtcgggctcccgggtcgaggtatggaggctagaattagttacgtggtgtcgtaggtttgggattcgacctagttctgggtagtcgggtcccgtagggttcggttcgggacgggtaggacccaaggtccgtcggacccgtcgtacggtaccacgaccccgaagggcctcgtccccgtacggtccaccgttccgtccgtttcccccgccc

SEQ ID NO: 336322 - DNA, 654 bp, Homo sapiens
  misc_feature: GZ8MTXP02H58SI.25.34.D01.1.454.CMB.2.raw
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggagacagcctacagaagtctattatgacaagctggaccagacaagaacgccaggacacggcccctgtacttgtacatactaagtaacggtaaaaaccaacccggaccctagaacggggtactacccgaaacgtacccgtattcctccgtcggcctaccgacgtactaccgaaacgggtaaccaccgtaacgtccctttacccgttaccgaaccctatacccgaacgtcggggcctacggacgggtacggaagtacgtggaacggtctaggtacttaagttacgtaggttaacccgtaccggacacgacgtacgtaagtaaacctaattaaagttgtacgttacgttaacggaacgtacggaaaccgtaacggtaccacccgtacgttacgacgacgacccgaaccgacccaaccctacgtcacctactaccttcccc

SEQ ID NO: 336323 - DNA, 573 bp, Homo sapiens
  misc_feature: GZ8MTXP02II0E3.25.34.D01.1.454.CMB.2.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagcccaccctnagtgtctgggacccccgggnagagggtctccatctcttgttctgggancagctccgagtcggaaattagtttgtctactggtaccngcagctccagaaccggccccaagctctcatctataggaatgatcagccggacccctgagggactacctgaccgattctcgtggctcgaagtctggcctcctccggccctccgtggccatcgaggtcgggcctccggtcgagacgtgagggctagaattagttactggtgactaggtttgggatcggcctagttcgtggtaggtcgggtaccggagggttggttcggggacggtagggaccaaggcctacggaccgtcgttaggcacggacccgaaggtcctcgcccccgtggtccacgttcctcgtccccgaccc

SEQ ID NO: 336324 - DNA, 561 bp, Homo sapiens
  misc_feature: GZ8MTXP02F0JU4.25.34.D01.1.454.CMB.2.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaggacaggcccctgtacttgtcatctataggtaaaaacaccggccctanacgggatccccagaccgattcncctgctcagctacagacncagtcttcctgacatcacgtggggctcgaggcgaagatgagctgactntactgtaaccgtcccgggaanagacgagtacgtaaactattaagttagtcgtacgtacggtaacgtacgggaccgtaaacggtcctaacccgtacgtacggtaccaccggaacccgaaacggaccccaaaccccgtacgtccgtacctaccgttcccgtccg

SEQ ID NO: 336325 - DNA, 577 bp, Homo sapiens
  misc_feature: GZ8MTXP02HT5N5.25.34.D01.1.454.CMB.2.raw
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacgtcaatcaccatttccngcactggaaccagcactgatgtgctactttgaccttgtctcttggtaccaacaacaccgacaagctccaactcataattttganaccagtaagcgccctgtgggtttctagtcgattcactgctcaagtctgcaacacgcctctacaatctctggctccagctgaaagacgaggctgtttatttctgtcttgtgctatgtggctagaaaactagtttggtgcgtcgggacgggaacgggaccctaaagttcggtacgttacgttaacggtacacggaccccgaaagggtccctccggccccccgttcggtcctaaccgtttccgttaccgtttcccccctaaccccttccccttccgtaacctttaccgg

SEQ ID NO: 336326 - DNA, 521 bp, Homo sapiens
  misc_feature: GZ8MTXP02GFJ30.25.34.D01.1.454.CMB.2.raw
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttgctacttgaccttgtctctgtaccaacacaccgacaagctcaactcatatttganaccagtagcgcctcgtggggtttctagtcgattcactggctccaagtctggcaacncgcctacctacaatctctgggctcagctagaagacgaggtctgtttatttctgtctgttgcttagtgtggctagaaaactagtttggagcgtcggacggacgggaccctaagttcgaccgtacttaacgtcagccaagctacgcccctcgccaacgtctcgtcccacctcctcactacg

SEQ ID NO: 336327 - DNA, 614 bp, Homo sapiens
  misc_feature: GZ8MTXP02H4FQX.25.34.D01.1.454.CMB.2.raw
  modified_base (449)..(449): a, c, t, g, unknown or other
  misc_feature (449)..(449): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagaagccaggacaggcccctgtacttgtcatctaatacggtaaaacaacccggccctacgagggactccccaagacccgattctcctggcctcagctcaaggaacacagcttccttgaccatccacgtggggactcgaggacggaaagatggaggacagaaccttatttaccgtcgttaaaccgcccggggtanacgtacgaggtaacggtaaacctaattaaagttatacgttacgttacgggaaaaccgttcggggaaaccctaaacgggttccaaacccggttccgtaacgggtccaacggacccccgaaaaggcccccaaaacccctagttccgtaacctacttaccccgtcccg

SEQ ID NO: 336328 - DNA, 598 bp, Homo sapiens
  misc_feature: GZ8MTXP02JGK4C.25.34.D01.1.454.CMB.2.raw
  modified_base (191)..(191): a, c, t, g, unknown or other
  misc_feature (191)..(191): n is a, c, g, or t
  modified_base (283)..(283): a, c, t, g, unknown or other
  misc_feature (283)..(283): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggagcagctccgacgtcggaaatagttgtctactggtaccagcagctccagaaccgccccaagctccnatcatagatgatcagcgcctgagggactacctgaccgattctctggctcgaagtctggctcctcggccctccgtggccagtccaggtcgggcctccgggtccgaggatggaggctagaattattacgtgtgacgtagtttgggatggcctagtctggagtcggtcgagggttggtcgggcgggagggtaccaaggtccgtacggtacccgttcccggtaaggttccgaccggtaccccgaaaggggtccctccgggtacccccccgttacggggttccctaacccgttccgtttcccggttcccccgttcccccg

SEQ ID NO: 336329 - DNA, 545 bp, Homo sapiens
  misc_feature: GZ8MTXP02I5VMO.25.34.D01.1.454.CMB.2.raw
  modified_base (208)..(208): a, c, t, g, unknown or other
  misc_feature (208)..(208): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacacacggacaaaggctccaaactcataattttgagaccagtaagcggcctctggggtttctagtcgattcactggctcccaagtctggcaacacggcctccctaacaatctctgggctccaggctgaaagacgaggctgtttattctagctgttgctatgtggctagaaactagtttggtgtcgtcgggacggagggaccctaagttcgaccgttacttaaggtcacggacccaaggctacgccccctaggtccactctcgttcccacccttcctactacc

SEQ ID NO: 336330 - DNA, 555 bp, Homo sapiens
  misc_feature: GZ8MTXP02I40CM.25.34.D01.1.454.CMB.2.raw
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
  modified_base (436)..(436): a, c, t, g, unknown or other
  misc_feature (436)..(436): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcagaagccaggacaggcccctgtacttgcatctaataggtaaaaaccaccggccctacgagggactccccagacccgattctcctggctccagctacaggaacncacgcttcctagacccatcacgtggggctcgaggacgtaagagtgaggctgactattactacgtaaccgtcccgganagacgagtacggtaaaccattaatacttgtcgtacgaacgtcgggaaccaaggtccaaccgtccgtacggtacacgacccgaacggaccccaacccgtactcgtaccacttcgtacccg

SEQ ID NO: 336331 - DNA, 627 bp, Homo sapiens
  misc_feature: GZ8MTXP02HA0KF.25.34.D01.1.454.CMB.2.raw
  modified_base (335)..(335): a, c, t, g, unknown or other
  misc_feature (335)..(335): n is a, c, g, or t
tcagactgtacagtcacgaccggtgctcgatttagatcgtctgtgttgggtttgggggctcagaagcagagttctgtggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgtcatctatacggtaaaaacaccggccctacgaggactcccgagaccgattcccnctgctccagctcaggaacacacgtccttcctagacccatccacgtgggggactacggagggtaccgaaagtcgtaggaacggcttacggaaccttaagttaccgtaggtaaacccgttcccggggaactacggacctaaggtacggtaaacctaattaactttagtacggttacttacggggaaaactcgggggtaaaccccaaggggtttaccacccggttaccgtaaacggtccgaacgaacccccgaaaggacccccaaaaccctacgtccggtaccaaccgtttcccg

SEQ ID NO: 336332 - DNA, 577 bp, Homo sapiens
  misc_feature: GZ8MTXP02H8IZI.25.34.D01.1.454.CMB.2.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacgtnaatcacctatttccngcactggaaccagcactgatgttggcttacttgaccttgtctcttgtacaacaacaccgacaaaggcaccaactcattaatttganaccagtagcgcctgtggggttctagtcattcactgctcaacgtctagcaacacggcctaccctacaacttctcgtggcctccgaggtctacgaagacgagtcttgttatttctgtcttgtgtctagtgttaggtctaagtaaaacgtagttggtagcgttacgggcggtacggaccctaaagttcgtaccgttactttaaacgcgtacgaccaaacgggtccttaccgcccccgttggtaccaaccgttccgttccgttaccccacccttccctactacttcg

SEQ ID NO: 336333 - DNA, 526 bp, Homo sapiens
  misc_feature: GZ8MTXP02IX641.25.34.D01.1.454.CMB.2.raw
  modified_base (358)..(358): a, c, t, g, unknown or other
  misc_feature (358)..(358): n is a, c, g, or t
tcagactgtacagtcacgaccggtgctcgatttagatcgtctgtgttgggtttggggagagaagacaggattcaggacaatctccagcatggcctggtctcctctcctcctcactctcctcgctcactgcacagggtcctgggcccagtctgtactgacgcagccgccctcagtgtttggggccccaggcgagagggtcaccatctcctgcactggggacagttccaatatcggggcaccttataatgttcactggtatcaacaacttccaggacagccccaaactcgtcattcatgctgataacaatcgtcctcagtcgtccctgaccgattctccggctccaagtctggcacctcncgcctccctggtcacgtcactgggctcagactgagatgaaggtgattacactgacctagtcctatgacacagcctgcgttggttgtcgttcggcggtcggaccaagggtcgcgtcggtacctaagtcagtacccgaaggccttcgcccccgtggtccactcgttcccg

SEQ ID NO: 336334 - DNA, 603 bp, Homo sapiens
  misc_feature: GZ8MTXP02F182N.25.34.D01.1.454.CMB.2.raw
  modified_base (238)..(238): a, c, t, g, unknown or other
  misc_feature (238)..(238): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (436)..(436): a, c, t, g, unknown or other
  misc_feature (436)..(436): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggaccagcagaagccaggacacggcccctgtacttgtcatctaatacggtaaaaaccacccggccctacagggactccccaagaccgtattcncctggctccagctacaaggacncagtccttccttgaccatcacgtggggctcgaggcgaagatgaggctagactattactgtaaaccgtcccgggaanagaccgtaagtacgtaaaccaattaaacgttatagttacgtacggggtaaacgtacggggaaccctaaaggggttcccaaacccggttcccgtaaacggtaccaaccggacccccgaaaacggcccccaaaaccccgacgttcgtacctaaccttcctttaaccccg

SEQ ID NO: 336335 - DNA, 772 bp, Homo sapiens
  misc_feature: GZ8MTXP02IE1OL.25.34.D01.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagactgtacagtcacgaccggtgctcgatttagatcgtctgtgttgggtttggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctnaagaagctattangcaagctggaccagcagaacgccaggacacggcccctgtacttgtcatctaagtacggtaaaaacaccggccctagacgggactcccgaagacccgtattctccgtcggcctaccgagccttaccgaagggaaaccctaccttaaacctttcccgttacgaacccctagtaccgtaccggttacgggggcctaccggaaggggccgggaaaaggagttaggggaacgggttaccttaaggtaaacccttagtttaaaccgtacggtttaaaaccccgttacccccgggggaaagaacggtacccgtaagggttaaccgggttaaacccaaagtttaaaactttgtacggtttacgtttaccggggaaaaccgttacggggtaaacccgtaaaacgggttaccctaaccccggttaccgttaaacgggggtacccaaccgggttaacccccgaaaacgggtaacccccccgtaaaacccccgatttaccggtaacccctaaaccgtttcccgttaccggtttaccccccccg

SEQ ID NO: 336336 - DNA, 724 bp, Homo sapiens
  misc_feature: GZ8MTXP02GZ5P9.25.34.D01.1.454.CMB.2.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (347)..(347): a, c, t, g, unknown or other
  misc_feature (347)..(347): n is a, c, g, or t
  modified_base (493)..(493): a, c, t, g, unknown or other
  misc_feature (493)..(493): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggtttcttctgagctgactcaggaccctgctgtgtctggtggccttgggacagacagtcaggatcacatgaccaaggagacagcctnagaagcttattangacaagctggtaccagacagaacgccaggacacggcccctagtacttgcatactaataaggaaaaaccacccggccctacgaggactacccgaagaccgattcnccgtcgcctccagctacaaaggacacacgtccttacctcgaaccatcccgaacgtcggggcctacgaacgggaccggaaagtagtggaacggtctacggtaaccttaagttaaaccgtacggttaaacccgtcccccggggtaaanacggacgtaacgggttaaccggtaaaaccctaaagtttaaaacgtttaacgttaccggtttaccgtttaaaccgggaaaaccggttaccggggaaaacccgttaaacgggttacccctaaccccgggtttacccgtaacggggttaccaaccccggaaccccgaaaaccgggtacccccctaaaacccccgtacgtaccggtaaccctaacccgttcccgtttaacccccg

SEQ ID NO: 336337 - DNA, 527 bp, Homo sapiens
  misc_feature: GZ8MTXP02IQ2R3.25.34.D01.1.454.CMB.2.raw
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctacttgaccttgtctcttggtaccaacacaccgacaagctcaaactcataattttganaccagtaagcgccctntgggtttctagtcgattcactggctcaagtctgcaacacggcctcctacaatctctggctcgagctgagacgagctgtttattctgtctgttgctattggtggtactaggaaaactagtttgggtcgcgtcggacggagggaacccaagttcgaccgttcttaaacgtcagcccgaaaggctcgcccctgtcaactcctcgttcccgcctcctcactcg

SEQ ID NO: 336338 - DNA, 601 bp, Homo sapiens
  misc_feature: GZ8MTXP02I6UG5.25.34.D01.1.454.CMB.2.raw
  modified_base (468)..(468): a, c, t, g, unknown or other
  misc_feature (468)..(468): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaagctattatgacaagctggtaccagcagagccaggacacggcccctgtacttgcatctaagtaacggtaaaaaccaccggccctacgacgggactacccgacgaccgtattcctccgtcggcctaccgacgctaccgaacggaaccacacgtccttacctagactactccgacgtggggcctacgagggacggaagagtgagctagacttattacgtacgtaaaccgcccgggtanacgacgtaagtacgtaaactattaattagtcgttacgtacggaacgtacggaccgtaacggtcctaccgtacgtacggtaccaccgacccgaaccggacccaacccgtacgtccgtaccaccgttccttcccg

SEQ ID NO: 336339 - DNA, 692 bp, Homo sapiens
  misc_feature: GZ8MTXP02HWGTX.25.34.D01.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctnagaagctatangcaagctgaccagcagaagccaggacacggcccctgtactgtcatactaataacggtaaaaacaacccggccctagaacggggactcccaacgaacccgtattcctaccgtcggcctaccgacggactaccgaagggaaccacgtaacgtcctttacccttacgaaccctaagttacccaaccggttcgggggcccttacggaacggggacgggaaagacgttagggaacggtactacgggtacttaattacgtacgttaaacccgtcccggggaacagaccgtaaggttaggtaaaccctaattaaatttaacgtgtttacctaacgggaaccgttacggggaaccctaaacgggcctaacccggtaccgttaacgggcccaacggacccccgaaaacggacccccaaaaccccctaccgtaccggtacctaacccgtttccgttacccccg

SEQ ID NO: 336340 - DNA, 546 bp, Homo sapiens
  misc_feature: GZ8MTXP02GI3RG.25.34.D01.1.454.CMB.2.raw
  modified_base (241)..(241): a, c, t, g, unknown or other
  misc_feature (241)..(241): n is a, c, g, or t
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
  modified_base (428)..(428): a, c, t, g, unknown or other
  misc_feature (428)..(428): n is a, c, g, or t
  modified_base (527)..(527): a, c, t, g, unknown or other
  misc_feature (527)..(527): n is a, c, g, or t
tcagactgtacagtcacgaccggtgctcgatttagatcgtctgtgttgggtttggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaaggagacagcctcaagaagctattangcaagctggaccagcagaagccaggacacggcccctgtacttgcatctataggtaaaaaccaccggccctagaggactcccgagaccgattcncctgcctcagctacaaggacacagccttcctgaccatcacgtgggctgacggngaagatgaggctagactattactgtaaacctccccgggaanacgacgtagtacgtaactattaattcgtgttacgtacggacgtacggaaccgtagtcctaccgtacgtacgtccacgacccgaacgaccccaacccgtntcgtaccaccttcctaccg

SEQ ID NO: 336341 - DNA, 656 bp, Homo sapiens
  misc_feature: GZ8MTXP02G63BP.25.34.D01.1.454.CMB.2.raw
  modified_base (236)..(236): a, c, t, g, unknown or other
  misc_feature (236)..(236): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggtttctgttggttttcttctgagctgactcaggaccctgctgtgtctggtggccttgggacagacagtcaggatcaacatgaccaaaggagacagccctanaagaagcttaattatgacaagcgtaggtaccagacaagaacgaccgaggacacggcccctagtactgtacatactaagtaacggtaaaaaccacccggaccctacgacggactacccgaacgaccgtattctaccgtcggcctccgagtcctacgaaacggaacacacgtccttacctacgaccataccgacgtcggggacctacgaacggggacggaaagtagacggacggtctagtacttaacgttaaccgtacgtaaaccgtacccgggaacaagaccggtaagtacgtaaaccaattaacttagtcggttacgttacggaaacgttacgggaaccgtaacggtacccaccgttaccgtacgaccacgaacccgaacgacccctaaacccacgttacgacctaaccgttctaccccg

SEQ ID NO: 336342 - DNA, 582 bp, Homo sapiens
  misc_feature: GZ8MTXP02GMU96.25.34.D01.1.454.CMB.2.raw
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttgctactttgaccttgtctcttggtaccaacaacacccggacaacggctaccaaactcattaattttgagaccagtaagcggcctgtggggtttctagtcgattcactggctcaagtctgacacacgcctcctacatctcgtggctcgagctagaagacgaggtcttgtttattctgtcttgttcgctagtgtggactagtaaaactagtttgggtgcgtcgggacggtacggtaccctaagttcgtaccgttacgttaaacgtccacgacccgaaacggtcctcccggtacccccgttggtacctaaccgttccgtccggttacccccgcccttcctaccgtacgttaccg

SEQ ID NO: 336343 - DNA, 555 bp, Homo sapiens
  misc_feature: GZ8MTXP02HGLYL.25.34.D01.1.454.CMB.2.raw
  modified_base (208)..(208): a, c, t, g, unknown or other
  misc_feature (208)..(208): n is a, c, g, or t
  modified_base (301)..(301): a, c, t, g, unknown or other
  misc_feature (301)..(301): n is a, c, g, or t
  modified_base (426)..(426): a, c, t, g, unknown or other
  misc_feature (426)..(426): n is a, c, g, or t
  modified_base (456)..(456): a, c, t, g, unknown or other
  misc_feature (456)..(456): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggcttactttgaccttgtctcttggtaccaacaacacccggacaaaggctaccaaactcataattttganaccagtaagcgccctctggggttctagtcgattcactgctcaagtctggcaacacggcctaccctacaactctacgtcgggcctccgaggcctagaagaccgaggcttgtttattctgcttgttnctagtgtggtactagtaaaactagtttggngtacgtcggcggagggtaccctaaattcgaaccgttcttaacgtcgacgcccaaggctcgccccctggtcaacgtctcgttacccaccctcgctactcg

SEQ ID NO: 336344 - DNA, 528 bp, Homo sapiens
  misc_feature: GZ8MTXP02JVH09.25.34.D01.1.454.CMB.2.raw
  modified_base (355)..(355): a, c, t, g, unknown or other
  misc_feature (355)..(355): n is a, c, g, or t
  modified_base (405)..(406): a, c, t, g, unknown or other
  misc_feature (405)..(406): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttgctactttgaccttgtctcttggtaccaacaacacccggacaaaggctaccaaactcataattttgagaccagtaagcggccctctggggtttctagtcgattcactggctcaagtctggcaacncggcctcctacaatctctgggctcaggctgaagacgagctgtttatttcnnctgttgctatgtggctagaaaactatttggagctcgggcggagggaccctaagttcgaccgttacttaaagtcagccccgaaaggctcgcccctggcaactctcgtcccacctcctcactcg

SEQ ID NO: 336345 - DNA, 538 bp, Homo sapiens
  misc_feature: GZ8MTXP02ISIJN.25.34.D01.1.454.CMB.2.raw
  modified_base (207)..(207): a, c, t, g, unknown or other
  misc_feature (207)..(207): n is a, c, g, or t
  modified_base (447)..(447): a, c, t, g, unknown or other
  misc_feature (447)..(447): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacatttccngcactggaaccagcactgatgttgctacttgaccttgtctcttggtaccaacacaccgacaaggctaccaaactcataattttgagaccagtaagcgacctgtggggttctagtcgattcactggctccaagtctaggcaacacggcctaccctacaatctacgtcgggcctaccgaggctacgaaagacgaggcttagtttattctgcttgtgctatgtgtctagtaaaactatttggngctgggacgacggaccaagttcgacgtcttaaggcacgccaaggctccgtcccctggtacaaccttcgtcctcccaccctcctacacgtcg

SEQ ID NO: 336346 - DNA, 542 bp, Homo sapiens
  misc_feature: GZ8MTXP02GIGNN.25.34.D01.1.454.CMB.2.raw
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggactcctggacagtcggtcaccatctcctgcactggaaccagccgtgacattggtgcttataactatgtctcctggtcccaacaacacccaggcaacggcccccaaactcatcatttatgatgtcagtcatcgccctctggtagtttctggtcgccttctctggctcagtctggcaactccggcctccctgacctactcgtccgggctccgaggctagacggacggaggctacttattattgctatttcatacagacgacacaacagtctggtgtcggacggtacggaccaaggttcgaccgtccgtcggtacacgtcccgaaggtcctccgtacccccgtcggtcctaccgttcgttccccg

SEQ ID NO: 336347 - DNA, 700 bp, Homo sapiens
  misc_feature: GZ8MTXP02F6WPW.25.34.D01.1.454.CMB.2.raw
  modified_base (247)..(247): a, c, t, g, unknown or other
  misc_feature (247)..(247): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaaggatcacatgacccaaagggagaccagccctacagaagcttattangacaagctggtaccagacagaacgccgaggacacggcccctgtacttgcatctaataacggtaaaaaccaccggcccctacgacgggactaccccgaagaccgtacttcgtcgtcggcctaccgagctaccgaacggaaccacgtaacgtccgtttaccctagaccctaatccgacgttcggggcctacgagggaccggaaagacgaggacggtacctaggtaaaccttaacgttaaccgttaccggtaaaacccgttccccggggaactaacggaccgtaacggtaaccgttaaaaccctaattaaagtttaacgtcggttaaccgttaccggggtaaacgttaccggggaacccgtaaacgggtcccgtaacccggttaccgttacggtacccgaccgaaccccgaaccggaccccaaaacccgtacttccgacctaccgtcgtttacccc

SEQ ID NO: 336348 - DNA, 679 bp, Homo sapiens
  misc_feature: GZ8MTXP02H1HIT.25.34.D01.1.454.CMB.2.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
tcagactgtacagtcacgaccggtgctcgatttagatcgtctgtgttgggtttggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctnagaagtctatangcaagctggtaccagcagaagccaggacacggcccctgtactgtcatctagtaaggtaaaaaccaccggcctagagggactcccaaagaccgattctaccgtggcctcgagtctaccgaaggaaccacagtcctttcccgttacgaacccagtttcccgaacgtcgggggacctaccggacggggaccggaaaaggtagttacgggacgggtacccttagggaaacctttaaacttaaccggttaccggttaaacccggttcccccgggggaaacaaccgggtacgtaaacggtaaccgtaaaacctaagtttaaaacgttcgttacggttaccgtaacgggaaacgttcgggaaaccgtacggtaccctaaccggtcgtaacgaccgaaccgacccgaacgaccccaacccgtactcgtaccctacgttaccgtcccg

SEQ ID NO: 336349 - DNA, 533 bp, Homo sapiens
  misc_feature: GZ8MTXP02I20HU.25.34.D01.1.454.CMB.2.raw
  modified_base (239)..(239): a, c, t, g, unknown or other
  misc_feature (239)..(239): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaggacaggcccctgtacttgcatctaatacggtaaaaacaccggccctagagggactcccgaagaccgattcctctggctccagtctcgaaggacacacgtcttcctgaccatcacgtgggctgaggcgaagatgagntgactattacncgtaaacgtcccggganagcgtaagtcggtaaacattaaattatgttacgtacggaactcgggaacaagggtcaccgtctacggacaggacccaagcccaaacccacgtcactctcttcccg

SEQ ID NO: 336350 - DNA, 684 bp, Homo sapiens
  misc_feature: GZ8MTXP02IKBGM.25.34.D01.1.454.CMB.2.raw
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctaattangcaagctggaccagcagaagccaggacacggcccctgtacttgtcttctaacggtacgaaaaacccncccgcccctanacgggactctcagaccgattctccgtcggcctcccgcctcaaacggaaacacgacgtccttaccttcgacccaagtccacgtcggggctccgaggcgacaaaggagtcggaacggtcctagtaacctaatttacccgttccggtttaccccgttaccccgggggaaacctacccgtaagggttacgggtaaacggtccgttaagggggtttggtcggggtttaccgttcgggggacgggtaaccgggaacccggtaaaagggtcggaccccggtttaccggaacggtacccgaaacggccccgaaaggggtccctcccggaccccccgtcgggttacccctacccgttccgttcccgttcccccg

SEQ ID NO: 336351 - DNA, 538 bp, Homo sapiens
  misc_feature: GZ8MTXP02JZVFZ.25.34.D01.1.454.CMB.2.raw
  modified_base (220)..(220): a, c, t, g, unknown or other
  misc_feature (220)..(220): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctcgggaccccccgggcagagggtctccatctctgttctgggancagctccgagtcggaaattagtttgctactggtaccagcagctcccagaacgcccccaagctcctnatcataggatgatcagccggcctnaggatacctgaccgtatctctggctaccgagtctgctcctcgcctccgtgccatcagtgggcctccggtccgngatgaggctagaatattactgtgcgtaggtttggagttgctagttctaggagtggtccgacgggttgttcgggcggacgggggacaaacggcgtgacccgtccgtacggtcacgacccagctcgccccctcgtccactcctcgttcccctacccc

SEQ ID NO: 336352 - DNA, 570 bp, Homo sapiens
  misc_feature: GZ8MTXP02IPUZO.25.34.D01.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (402)..(402): a, c, t, g, unknown or other
  misc_feature (402)..(402): n is a, c, g, or t
  modified_base (533)..(533): a, c, t, g, unknown or other
  misc_feature (533)..(533): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgtgcttacttgaccttgtctcttggtaccaacaacacccganaaagctaccaaactcataattttganaccagtagcgcctcgtgggttctagtcgtattcactggctccaagtctgcaacaccgcctccctanactctctgggcctcaggctagaagacgagctgtttattcngtctgttcgctagtgtggactagtaaaactaagttttgggacgcgtacggggcggtacggggaaccctaagttcgaccgttacgttaaacggtcacggcccgtaaacgggcctcggcccccgttcggtacnccgttactccgttccccgcccttacctctactttacg

SEQ ID NO: 336353 - DNA, 749 bp, Homo sapiens
  misc_feature: GZ8MTXP02F2M3R.25.34.D01.1.454.CMB.2.raw
  modified_base (270)..(270): a, c, t, g, unknown or other
  misc_feature (270)..(270): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacctatttcctgcactggaaccagcactgatgttgcttacttgaccttgtctcttgtaccaacacaccganaacgctacaactctattatttgacgacagtaacgcgccttcgtgggtttctagtcgattcactcggctaccaagtctcggacaacgaccggtcccttaccctactaactcgtcgtcggggtcctccgtaggccttaggaaacgtaccggtaggtactttggttttatttccgtggttccgttggtttcgaacttgttagggttcggtaaaccttaaaggttaaaaccgttaagtttttcggggtacggtacccggtttaccgggggacgggttaaaccgggggtaacccttaaacggtttaccggtaaacccggtttacgtttaaaaccggtaccgtaccgggtaccccgtaaacgggttcccgttacccccggtacccccggtttccgggttaaacccgtaacccgttttaccccggttccccgtttttaaccccccccgtacccccgtttaccccgttaccgttaaccggtttaccg

SEQ ID NO: 336354 - DNA, 749 bp, Homo sapiens
  misc_feature: GZ8MTXP02JRWKA.25.34.D01.1.454.CMB.2.raw
  modified_base (393)..(393): a, c, t, g, unknown or other
  misc_feature (393)..(393): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggtttcttctgagctgactcaggaccctgctgtgtctggtggccttgggacagacagtcaggatcaacatgaccgaaggagacagcctacaagaagctaattatgacaagctggaccagacagagccaggacacggcccctagtacttgctatactaagtaacggtaaaaaccacccggtccctacggaacggactacccgaacgacccgtattcctccgtcggcctaccgacgcctacgaacggaaccncgtaacgtccctttacctacgaaccctacgtaccgaccgggttcgggggacctacgggaacggggtacggaaagtagtcgggaacggtccgtaacggtaaccttaaacgtttaccggtaccggttaaaccccgggtccccggggaaagaccggtaacgtaaacggttaaaccgttaaaccttaagtttaaacgtttacggttaccggtttaccggtaaccgggaaaccggttaccgggaaacccgtaacggtcccgtaacccggttaccggttaacggaccccgaacccggaacccccgaacccggtacccccaaaccccgtacgtaccgtacccctaccgttacccgttcccccg

SEQ ID NO: 336355 - DNA, 674 bp, Homo sapiens
  misc_feature: GZ8MTXP02H49H5.25.34.D01.1.454.CMB.2.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (573)..(573): a, c, t, g, unknown or other
  misc_feature (573)..(573): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctccgtgacggtcaatcacctattcctgcactggaaccagcactgatgttgcttactttgaccttgtctctgtaccaanaacaccagacaagcaccaactcattaatttganaccagaacgcgcctgttgggtttctagtcgtattcacgtggctcccgaagtctaggacaacgtaccgacctacccctaaactaactcctaccgttcgggccttacccgaggtacccaggaaagtaccggacggttaccgtagtttttactttccggttgtccgtttggtttgaccttaagtttcggtaccggtaatttaaacggtaaaaattagggttttacggtcggaccgttccgggggacggaacggtaacccgtaaagtttccggaaacccgtttnttaaaacggtcgaacgtacccgaaacgggtccctaccggtccccctagggtcccgttaactcccgttacccgttcccccgtccccttaccttccgtaaccg

SEQ ID NO: 336356 - DNA, 609 bp, Homo sapiens
  misc_feature: GZ8MTXP02I94G2.25.34.D01.1.454.CMB.2.raw
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (439)..(439): a, c, t, g, unknown or other
  misc_feature (439)..(439): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctataggtaaaaaccaccggccctacagggactccccagacccgattccncctggcctccagctacaaggacncagtcttcctgaccatccacgtggggacctagaacgcggaagatagaggctgaactattacgtacgtaaccgtcccggganacgacctaaggtacggtaaacctattaagttacgtacgttaccgttacgggtaaccttacggggaacccgtaaaacgggttccctaaaccggttccgtacgggtaccgaaccgaccccgaaacggacccccgtaaaaccccacgtcgtacccaaccttacgtttcccccg

SEQ ID NO: 336357 - DNA, 586 bp, Homo sapiens
  misc_feature: GZ8MTXP02HMRKX.25.34.D01.1.454.CMB.2.raw
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaggctaccaaactcataattttgagaccagtaagcggcctcgtggggtttctagtcgattcactggctcaagtctgcaacacggcctcctacaatctcgtggctcaggctgaagacgagcttgtttatttctgtcttagttgctatggtgctagtaaaactatttgggagcgtcgggcggacgggtaccctaagttcggaaccgttagttaacgtcgtaacgccccgtaaagggtccctccggccccccgttcggtaccctaaccgtttccgtaccggtttcccccaccccttccctacctaccgtttaccg

SEQ ID NO: 336358 - DNA, 555 bp, Homo sapiens
  misc_feature: GZ8MTXP02GDIGP.25.34.D01.1.454.CMB.2.raw
  modified_base (208)..(208): a, c, t, g, unknown or other
  misc_feature (208)..(208): n is a, c, g, or t
  modified_base (313)..(313): a, c, t, g, unknown or other
  misc_feature (313)..(313): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
  modified_base (542)..(542): a, c, t, g, unknown or other
  misc_feature (542)..(542): n is a, c, g, or t
tcagactgtacagtcacgaccggtgctcgatttagatcgtctgtgaggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctncactggaaccagcactgatgtgctacttgaccttgtctcttggtaccaacaacacccggacaaaggctaccaaactcattaattttgagaccagtaagcgccctntgggttcagtcgattcactgctccaagtctggcaacacggccctccctactaatcctacttcggggcctccgagggcctagaaagaccgaaggtcttagtttatttcngtctgttnctatgtgctagaaaactatttggncgtcgggacggagggacccaagttcgacttcgttaagtcagtccccaaaggcctcgacccccgtggtaccaacgttctcggttcccccnccctcctctactg

SEQ ID NO: 336359 - DNA, 595 bp, Homo sapiens
  misc_feature: GZ8MTXP02I0TJG.25.34.D01.1.454.CMB.2.raw
  modified_base (400)..(400): a, c, t, g, unknown or other
  misc_feature (400)..(400): n is a, c, g, or t
  modified_base (498)..(498): a, c, t, g, unknown or other
  misc_feature (498)..(498): n is a, c, g, or t
  modified_base (563)..(563): a, c, t, g, unknown or other
  misc_feature (563)..(563): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctcggacggtcaatactaccactttccttcgcactacggaaccaacgcactgatgttggtcgtactttcgtaccttcgttctcttggttaaccaaaccaaacaacccggacaaaggactccaaaacctactactaaatttttgtagaacctaacgtaagaccggccctcttggggtttctagtcgattctactggctccaagtctgcaacacgccncctacaatctctcggctcagggctacgaagacgaggcttcgttttatttcttctgttgactatggtggctaagaaaaactattttggtgactccgggnggacgggtacccaaagttgaccgtactttaagcgacgtaccgaaacggtctcgccccctacggtnactcgtcgttcccacctcctacgtctacgtac

SEQ ID NO: 336360 - DNA, 757 bp, Homo sapiens
  misc_feature: GZ8MTXP02J3KGT.25.34.D01.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggtttctctgagctgactcaggaccctgctgtgtctgtggccttgggacagacagtcaggatcacatgaccaagganacagccctnagaagtctattangacaagctggtaccagcaagaagcccaggacacggcccctgtacttgtacatctaagtaacggtaaaaaccaacccggcccctacgaaggggtactccccgaagtaccccgtattcctccgtcggcctcccgagtcctacgaacggaaccaccgtacgtcccttttccgttacgacccctaagtcccgtacgttcgggggacctacgaacggggtaccggaaagtaacggttagggaacggtcttaacgggtaaaaccgtttaactttaaccggttaacggtttaaaaccccggtcccggggtaaacgtacgggaaccgttaacggttaaccggtaaaaccctaagtttaaacttaaggtttcggtttaaccgtttaaccgggaaaaccggttacggggaaacctaaacgggttaccaaaccccggttcgtaaccgggtaccaacccggaccccgaaaaccggtcccccaaaaccccgtcgttaccgtacccttaacttaccccgtttcccccgg

SEQ ID NO: 336361 - DNA, 614 bp, Homo sapiens
  misc_feature: GZ8MTXP02IS3YO.25.34.D01.1.454.CMB.2.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagtaacttatatgcatcctggtaccagcagaagccggacacggcccctntacttgtctttctacggtacgaaaaccnccccgcccctgagggactctcacgacccgtattcctcgtcggccctcccgcctacaacggaaacncacgtccttcctacgaccctatcgacgtggggctacgaggcgacaagatgagctagtacttatactcgttcccgtcccgggacaccgtagtacggtaagcgtagggttgtcggttcgttcgggacgggtaacggggaccgtaacgggtacgacccggttacgtacggggtaccacggacccgaaacggcctaccggtcccccgtcggtacctaccgtccgttccggttacccccaccctttcccg

SEQ ID NO: 336362 - DNA, 619 bp, Homo sapiens
  misc_feature: GZ8MTXP02GZK3R.25.34.D01.1.454.CMB.2.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagccctnagaagctattangacagctgaccagacaagacgccgagacacgccctgtactgctatactaagtaacgtaaaaccaccggacctacgacggacctacccgaagtacctattcctccgtcgacctacgacgtcctacgaacgaccacgtacgtccttaccgtacgaaccataccgtacgtcgggacctacggagggacgaagagtcggagtactagacttacttaccgtcggtaaccgtacggacaggacgtacggtaacgtaaacatttaacgttagtcgtacggtacgtaacgtacgggaacctaacggttaccacccggtacgtacggaccaccggacccgaaccggacccccaaacccgtcgtaccgtacctaccttaccgttaccc

SEQ ID NO: 336363 - DNA, 567 bp, Homo sapiens
  misc_feature: GZ8MTXP02IFOZE.25.34.D01.1.454.CMB.2.raw
  modified_base (212)..(212): a, c, t, g, unknown or other
  misc_feature (212)..(212): n is a, c, g, or t
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
  modified_base (549)..(549): a, c, t, g, unknown or other
  misc_feature (549)..(549): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctccgtggacggtcaatcacctatttccngcactggaaccagcactgatgttgcttacttgacttgtctctgtaccaacacaccganaagctacaactcatatttganacagtacgcgcctgtgggttctagtcgatcacgtgctcaagtctgcacacgcctaccacatctctggacctcgagtctagaagacgtaggtcttagtttactttctgtcttgttcgtcgttagtggtacggtaccttaagtaaaactagttttcggcgtcgtacgggacggacggtaccctaagtcgtacgtacgttacgacacgaccctaggccctaccgcccccgttaggtcctaaccgttctcccggttaccccnccttcctactacgtaccg

SEQ ID NO: 336364 - DNA, 605 bp, Homo sapiens
  misc_feature: GZ8MTXP02G2FEK.25.34.D01.1.454.CMB.2.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (304)..(304): a, c, t, g, unknown or other
  misc_feature (304)..(304): n is a, c, g, or t
  modified_base (593)..(593): a, c, t, g, unknown or other
  misc_feature (593)..(593): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctccgtgtctggtctccgtggacgtcaatcacctatttccngcactggaaccngcactgattgttgcttacttgaccttgtctcttcggtaaccaacaaccaccggacaaacgctaccaaactctattaatttganacagtacgcgcctgtgggttcagtctattcacgtgctcaacgtctgactacgacgtccctaccacactctcgtcggcctcgaggtctagaaacgtacggtacgtctttagtttacttctgtcttgttcgcgttagtcggtagacgttaaagtaaaacgttagtttcgggcgacggtcgggacggtaacgggtacctaagttccgtaacgttacgtacgaccgacgtaccgaacggtccgtacccgtccccgtacgtcctaaccgttccgtaccttaccccacccttacnccttaacgtcgg

SEQ ID NO: 336365 - DNA, 562 bp, Homo sapiens
  misc_feature: GZ8MTXP02JR99N.25.34.D01.1.454.CMB.2.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (456)..(456): a, c, t, g, unknown or other
  misc_feature (456)..(456): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcacctatttccngcactggaaccngcactgatgttggcttactttgaccttgtctcttggtaccaacaacacccgganaaaggctaccaaactcattaattttganacagtagcgcctgtgggtttcagtcgattcactggctcaagtctgcaacncgcctccactaactctcgtggctccgaggtcctaggaaacgacgaggcttaggtttatttctggtcttgttgctgtggtgactaggaaaacttgtttgggtncgtacgggacggtacgggaccctaagttcgacgttcgtttaaacgcacgaccgaagtcctaccgccccgtgtactccgtcttaccgtcccaccctcctacacgtac

SEQ ID NO: 336366 - DNA, 619 bp, Homo sapiens
  misc_feature: GZ8MTXP02JWIBN.25.34.D01.1.454.CMB.2.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtctgggacccccgggnagaggtctccatctcttgttctgggancagctccgacgtcggaaattagtttgtctactggtaccagcagcctccagaaaccggcccccaagcctcctcatctataggatgatcaggccgccctgagggactacccgtgaccgtattcctcgtggtctccgaagtctggtcctcccgtcggcccttcccgtgggcccatccgaggttcggggcctcccgggtccgaggacgtgaacgggtctagaattagttacgtgtgtcgttaggtttggggattcggacctgtcgtggtacgtggtccggacgggttggttcgggcgggacgggacgaagtccgtcggtacccgtcgtaacgggtccgacgccccgaaagggtccctcccggtcccccgtcggtcccaaccttccgttccgttccccctaccccg

SEQ ID NO: 336367 - DNA, 700 bp, Homo sapiens
  misc_feature: GZ8MTXP02JE80X.25.34.D01.1.454.CMB.2.raw
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaagcttaattatgacaagctaggtaccagacaagaacgccgaggaccacggcccctagttacttgtcatactaagtaacggtaaaaaccacccggaccctacgaagggtacctaccccgaaggacccgtacttccgtacccgtcgtccttaccaacgtctaccgaaacggaacctactaacggtcctttacccgttacgaacctacttaccgacgtcgggggtacctacgaacgggtacggaaagtactagggaacgtcgtaagtaaccttaacgtttaaccgtacggttaaaccggtacccgggacgacgtaccggtaaggtacggtaaacctaagttaaacttagtacgttacgtacgtaaacggtacggggtaaaccgaacggtaccgaaacccggttcgtacggtaccaccggaaacccaaccggacccctaaacccgacgttcgtacctaccttccttaccccg

SEQ ID NO: 336368 - DNA, 612 bp, Homo sapiens
  misc_feature: GZ8MTXP02H1D1M.25.34.D01.1.454.CMB.2.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
tcagactgtacagtcacgaccggtgctcgatttagatcgtctgtggagggggggtcacaagaggcagcgctctcgggacgtctccaccatggcctgggctctgctgctcctcactctcctcactcaggacacagggtcctgggcccagtctggcctgactcaacctgcctccgtgtctgggtctccgtgacgtcaatcacctatttccngcactggaaccngcactgatgttggcttacttgaccttgtctctggtaccaacaacaccgacaaggcacaactcatattttagagaccagtaagcgacctcgtgggttctagtcgtattcactggctacaacgtctggacacgacgtcctacctacaactctcgtgggcctccgagcgtagaacgacggagtctagtatttacgttactcgtactactactaatacgttacgaactactactaccaaactaaacctccgttaccgtaccggtaccgtacgggaaccgtacgggtacccgaaccgttcggtacggtaccgaacccgacccggaacggaccccaaaccctacgtcgtaacccgtaccttacctcccgttacccctacccctaccttacctaaccg

SEQ ID NO: 336369 - DNA, 779 bp, Homo sapiens
  misc_feature: GZ8MTXP02GCSY3.25.34.D01.1.454.CMB.2.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggagacagcctanaagaagctattangacaagctaggaccagacaagagcagacacgcccctgtactgcatactagtaacgaaaaacaccgcctacgacggactcccgaagacctagttctcgtacgcctacacgtcctacgaacgacacacgtcctttacctacgaacctacgttacgaacggttcggggtacctaaccgggaacgggaacggaaacgttaaacgggtacgggtaaacggtacgttaaacggttaaaccgtttaacgtttaaacccggttaaacccggttaaaccccgggtaacccgggaacgtaaccggtaacggtaaaaccgggttaaaccgttaaaacttaaacgtttaaacgttaaccggtaccgttaaacccgggttaaacgggtaaaccgggtaaccgggtaaaacccggtaaaccggtacccgtaaacccggttacggtaacccggtaacccggaaccccgaaacccccggtaaaacccgtaaccccccgtaaaacccgtaccgttacccgttaccccgttacccgttaccccgtttacccccg

SEQ ID NO: 336370 - DNA, 719 bp, Homo sapiens
  misc_feature: GZ8MTXP02JJZ1T.25.34.D01.1.454.CMB.2.raw
  modified_base (260)..(260): a, c, t, g, unknown or other
  misc_feature (260)..(260): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagcttatatgcaagctggtaccagcaaganccaggacacggcccctgtacttgcatctaagtacggtaaaaaccaccggccctagacgggtactccccgaagaccgattctccgtcggacctccgacgcctacgaagggaaaccacgtaagtcctttacccgttagaaccctaacttccgaaacgtcgggggtacccttaccggaaggggaccgggaaaggtaagttccgggaaaggggtcctaagggtaaaccctttaaatttaaaccccggtaggttaaaccccggttacccccgggggaataaaccgggacgtaaaacggtacgggtaaaaccctaatttaaacgtttacgtacggttaccgtttacggaaaaccgtttcgggggaaccctaaagggttcccgaaacccggtttcgaaccggggtccaaccgccccggaaaacgcccccgtaaacccacgtacgtcccaaccgttcttacccccgg

SEQ ID NO: 336371 - DNA, 544 bp, Homo sapiens
  misc_feature: GZ8MTXP02GJ656.25.34.D01.1.454.CMB.2.raw
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (404)..(404): a, c, t, g, unknown or other
  misc_feature (404)..(404): n is a, c, g, or t
  modified_base (535)..(535): a, c, t, g, unknown or other
  misc_feature (535)..(535): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttgctacttgaccttgtctctgtacaacacaccganaagctcaactcatatttganaccagtaagcgtccctgtgggtttctagtcgattcactggctccaagtctgcaacacgcctacctacaactctctggcctcagctagaaagcgagtcttgtttattctgtctggttnctagtgttggatagtaaaactagtttggacgtcgttcgggacgggacgggaccctaagttcgtaccgttcttaaacgtcacgacccgaaggtctaccgcccctggtccaacgttctcgtcccctacctccnctacgtacg

SEQ ID NO: 336372 - DNA, 603 bp, Homo sapiens
  misc_feature: GZ8MTXP02IJ6D8.25.34.D01.1.454.CMB.2.raw
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggttttcttctgagctgactcaggaccctgctgtgtctggtggccttgggacagacagtcaggatcacatgaccaaggagacagcctcaagaagcttattatgacaagctggtaccagcagaacgccaggacacgcccctgtacttgcatctataggtaaaacaccggcctagagggactcccgaagaccgattctccgtacggcctccagctacgaacggaaccacacgtccttccgtacgaccatccacgtggggcctcgaggcggaagntagaggctagactattacgacgtaaccgtccgganagcgaagtcgaaacctattaacttagtacgttacgtacggaaaacgtcgggaaacctaacggtcctacccggttaccgttacgggtaccaaccgaccccgaaacggacccccgaaacccctacgtcgtaccccaacctttccgtttacccccg

SEQ ID NO: 336373 - DNA, 589 bp, Homo sapiens
  misc_feature: GZ8MTXP02FVSO5.25.34.D01.1.454.CMB.2.raw
  modified_base (467)..(467): a, c, t, g, unknown or other
  misc_feature (467)..(467): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagccctacagaagctaattatgcaagctggtaccagcaagaagccaggacacggcccctgtacttgtcatctaagtaggtaaaaaccaccggcctacgacggactcccagaccgtatctctggcctcagctacgaaggaaccacagtcttaccttagaacctatccacgtggggcctacgaaagggcggaaagtagtcggaagtcctaggtaaacttacgttaacgtacgtaaccgtccccgganacgacgagtacggtaacaagttacttagtgtacttacggaacttacgggaccgtaagtccaccggtcttacgggacaccgacccgtaaccgaccaacccgtacgtctacacctcgttacccg

SEQ ID NO: 336374 - DNA, 537 bp, Homo sapiens
  misc_feature: GZ8MTXP02J4SSU.25.34.D01.1.454.CMB.2.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (266)..(266): a, c, t, g, unknown or other
  misc_feature (266)..(266): n is a, c, g, or t
  modified_base (508)..(508): a, c, t, g, unknown or other
  misc_feature (508)..(508): n is a, c, g, or t
  modified_base (519)..(519): a, c, t, g, unknown or other
  misc_feature (519)..(519): n is a, c, g, or t
tcagactgtacagtcacgaccggtgctcgatttagatcgtctgtggaggggggttcacaagaggcagcgctctcgggacgtctccaccatggcctgggctctgctgctcctcactctcctcactcaggacacagggtcctgggcccagtctggcctgactcaacctgcctcgtgtctggtctcctgacgtcaatcactatttccngcactggaaccngcactgatgttgcttacttgaccttgtctcttggaccaacaacaccganaaagctcaaatcataatttgagaccagtacgcggcctctggggtttctagtcgattcactggctcaacgtctgcaacacgcctcctacaagtctctgggactccaggctgagacgagcttgtttattctgtctgtttagctatgtaggacctgaaaacctatttggtcgcgtcggcggaggaaccccggtattacgaccgtactttaagtcagcccgaacgcgttcgccccttcggctaacnctcgttacccnccctcccttcacgttacg

SEQ ID NO: 336375 - DNA, 543 bp, Homo sapiens
  misc_feature: GZ8MTXP02GGQBC.25.34.D01.1.454.CMB.2.raw
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgcatctataggtaaaaacaccggccctnagggactcccagaccgattcncngctcagctcaggaacncagccttcctgaccatcacgtgggctcgaggcgaanatgagctgactattactgtaaacctcccgggaanacgacagtacgaactaattaattacgtcgtacgtacggaacgtacggaaccgtaacggtcctacccgtacgtacggaccgaccgacccgaacgaccccaaacccgtactcgtaccacttcctaccg

SEQ ID NO: 336376 - DNA, 543 bp, Homo sapiens
  misc_feature: GZ8MTXP02JNT1S.25.34.D01.1.454.CMB.2.raw
  modified_base (207)..(207): a, c, t, g, unknown or other
  misc_feature (207)..(207): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacgtcaatcacctatttccngcactggaaccagcactgatgttgcttactttgaccttgtctcttgtaccaacacacccgacaaaggctaccaaactcataattttgagacagtaagcgcctgtggggttctagtcgattcactggctcaacgtctgcacacggcctcctacaactctctgggctcaggctagaacgacgaggtctgtttattctgcttgttgctatgtggctacgaaaatagtttgggtagcgtacgggacggacggggaccctaagttcgtaaccgtactttaagacgacgccctaaaggcctccgccccgtcgtcaacctctcgtcccacctcctcacttacg

SEQ ID NO: 336377 - DNA, 566 bp, Homo sapiens
  misc_feature: GZ8MTXP02HYWKV.25.34.D01.1.454.CMB.2.raw
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacaggacagtcaggatcacatgaccaaaggagacagcctcaagaagctattangcaagctgacagcaagagcaggacacgcccctgtactgtcatctaagtaacggtaaaaacacccggccctagacggactcccagaccgattcnccgtcgcctcagctacgaacggacacagtccttccttacgacctatccagtcgggactcgaggacganagtgagctagactatacgtagtaaccgcggtanagacagtacgtaacaattaagtatcgttacgtacggaacgtacgggactaacggacctaccggtactacggtaccaccggacccgaaccggccccaaaacccgtcgtacctaccaccttccttaccccg

SEQ ID NO: 336378 - DNA, 624 bp, Homo sapiens
  misc_feature: GZ8MTXP02INI0Z.25.34.D01.1.454.CMB.2.raw
  modified_base (246)..(246): a, c, t, g, unknown or other
  misc_feature (246)..(246): n is a, c, g, or t
  modified_base (488)..(488): a, c, t, g, unknown or other
  misc_feature (488)..(488): n is a, c, g, or t
tcagactgtacagtcacgaccggtgctcgatttagatcgtctgtgttgggtttgggggctcagaagcagagtttctggggtgtctccaccatggcctggacccctctctggctcactctcctcactctttgcataggttctgtggtttcttctgagctgactcaggaccctgctgtgtctgtggccttgggacagacagtcaggatcacatgaccgaaggagacagcctacgaagaagctattagngacagcgtgacagacaagaacgcgagacacgccctagtactgacatactaagtaacgaaaacaccgacctagacggacaccgacgacctacttcctccgtcgcctaccgagtacctacgaacgaccacgtacgtcccttaccgtacgacctacgtccgtacggtcgggacctacggacgggacggaagtagtacggacgtactagtacttagttaaccgttacggtaaccgtacccgggaanacggtacgtaacgtaacgtaaactaattaagttacgtacgtacgtacggaacgtcggaaaccgtacggtcctaccgtacgtacgaccaacgacccgaaccgacccaacccgtactacgtaccgtaccgtcgtcccg

SEQ ID NO: 336379 - DNA, 648 bp, Homo sapiens
  misc_feature: GZ8MTXP02H4NQQ.25.34.D01.1.454.CMB.2.raw
  modified_base (484)..(484): a, c, t, g, unknown or other
  misc_feature (484)..(484): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgccaaggagacagcctcaagaagctatatgcaagctggtaccagcagaagccaggacacggcccctagtacttgtcatctaataggtaaaaaccaccggccctacgacgggactcccgaagacccgtattacctcctcggcctaccgacgctacgaacggaacactaagtccttccgttagaccatcgaacgtgggggcctacgaacgggacggaaagtagtcggaggtactaggtacttaacttacgtacggttaaccgtaccccggggaanacggtacgtaacggtaacgtaaactaagtttaagttacgttacggttacgttaacggaaacgtacgggaaaccgtaacggtaccgtaacccggtacgtacgtaccgaaccgacccgtaaaccgacccctaaacccgtcgtacgtaccctacgtttacccgtccg

SEQ ID NO: 336380 - DNA, 588 bp, Homo sapiens
  misc_feature: GZ8MTXP02IW6S6.25.34.D01.1.454.CMB.2.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (434)..(434): a, c, t, g, unknown or other
  misc_feature (434)..(434): n is a, c, g, or t
  modified_base (464)..(464): a, c, t, g, unknown or other
  misc_feature (464)..(464): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctanagaanctattangacaagctggaccngcagagcagacacggcccctagtacttgcatctaagtaacggtaaaaaccaccggccctacgagggactacccgagaccgtattcctcctggacctaccagacctacgaaacggaaccaccgtaagtccctttaccgtacgacccaattccaacgtgggcctacgaggacgaagtagngagctagactattacgtacgtaccgacganagacgaagtacgtaaactaattaatagttacgtacgtacggaacgtacggaacgtaacgtaccgaccgtacgtacgaccaaccgacccgaaccgtacccaaaccgtctacgacctactcctacc

SEQ ID NO: 336381 - DNA, 513 bp, Homo sapiens
  misc_feature: GZ8MTXP02FEG4R.25.34.D01.1.454.CMB.2.raw
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (500)..(500): a, c, t, g, unknown or other
  misc_feature (500)..(500): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctataggtaaaaacaccggccctcgagggatccccagaccgatttcncctggctcagctcaggaacncagcttctnacatcactggggctcgaggcgaaagatgaggctgactattacngtaactcccgggaanagcagtacgtaacaattaatntgtcgtacggaacgtcgggaacaggtccaccgtctacgcacgacccgaacgcccaacccnctcgtcactctcg

SEQ ID NO: 336382 - DNA, 632 bp, Homo sapiens
  misc_feature: GZ8MTXP02HD1Q6.25.34.D01.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (454)..(454): a, c, t, g, unknown or other
  misc_feature (454)..(454): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagcccaccctcagtgtctcggggaccccccggnaggagggtctccatctcttgttctgggancagctccgacgtcggaaattagtttgtctactggtaccagcagctccaagaaccggccccaagcctccncatctanagaatgatnagccgcccngagggatacctgaccgtattctcgtggctaccgaatcgtcggcctccgtccggccctccgtgcctatccgaggtcggccgttccgggtaccgaggagtgaggtctagtaaattattacgtgtcgagtggtttagggntcgacgtagtcgtaggtacggtcggtaccggtagggttcggttacgggacgggtaacgggaccgacggtcggtacggtacccgtaccgtacggaccaccggacccggtaaccggtcccgtaacccggtcccccgttcggtaccctacccgtttccgttaccccgttacccctaccccg

SEQ ID NO: 336383 - DNA, 571 bp, Homo sapiens
  misc_feature: GZ8MTXP02GCUYQ.25.34.D01.1.454.CMB.2.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (492)..(492): a, c, t, g, unknown or other
  misc_feature (492)..(492): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccngcactgatgtgctacttgaccttgtctcttgtacaacacaccganaacgcacaacnctattatttganacagtagcgcctgttgggttctagtcattcatcgctacaagtcgtgacaacgccggtccctacctactactctacgtcggcctacagctagaagacgtaggtcttggtttacttcngtcttgttnctagtcgnggtactagtaaaacgttgttcgggttcgaccgtacgggacggtacgggaaccctagttacgtacccgtntttaaacgcgacgaccgtagccttaccggacccccttgtacgaaccttcgtcccggttccccaccttccaactcgtacg

SEQ ID NO: 336384 - DNA, 783 bp, Homo sapiens
  misc_feature: GZ8MTXP02GIP0R.25.34.D01.1.454.CMB.2.raw
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagggagacagcctacgaagaagtcttaattagtcgacgaagtcgtacggtaccagacaaggacgaccgaggacgaccggccctagtacttgactatactaagtaaacggtaaaaaccgacccgacctacgaaggtaccacccgacgaaccgtacttacctccgtacgtcctacgacgtctacgaaacggaaccacgtaacgtccttaccgtaccgaacctactaccgtaccgggtggggtaccctacgggacgggggaacggtaaaagtcggtacgggtacggtacgtaacggtaaacctttaacgtttaccggttaacggttaaaacccggggtacccccgggaaagtaccggtaacggttaagggttaaacccggttaaaacctaaaggttttaaatttaacggttcgtttaaaccgggttaaccggtaaaaccgggttaaccgggtaaaaccggttaaccggtacccgttaaaaccccggtccggttaacggacccgtaacccgaaccccgaaacgtaccccccaaacccgtacggtcctacctaacccgttaccgtttcccccgg

SEQ ID NO: 336385 - DNA, 646 bp, Homo sapiens
  misc_feature: GZ8MTXP02F5WOI.25.34.D01.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
  modified_base (496)..(496): a, c, t, g, unknown or other
  misc_feature (496)..(496): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctggtcggccttgggacagacagtcaggatcaacatcgaccaaggganacagccctagaagaagactattangacaagctggtaccagcaagaagccgaggacacggtcccctaggttacttcgctactactaacgtaacggaaaaaccacccgggccctaggaacgggtactaccccgaagaccgtacttctccgtcgcctacgagactacgagaaccacacgtacctcctacgacctntcgacgtgggctcgaagggacgaagtacgnggaacggtctaggtacttaacgttaccgtacgtaaccggtacccggganaccgtacgtaacgtaacggtaaacctattaacgttaacttggtaccgtaacggaacgtacggggaccaacggtaccgtaccggtacgtacggtaccaccgtaaccgaaccgaccccaaccgtacgtacgtaccgacgttaccgttccccg

SEQ ID NO: 336386 - DNA, 813 bp, Homo sapiens
  misc_feature: GZ8MTXP02JSL69.25.34.D01.1.454.CMB.2.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtcgtcggggacccccggnaggagggtctccatctcttgttcgtgggancagctccggacgtacggtaaattaagtttgtcttaactggtaccagcagcctacccgagaaacccggccccagcctcctacactactaataggaatgactcgacggccggaccctagacgggtactacccgtcgtaccgtacttcgtcgtcggtacgtaccggaacgttccgtcggcccttcccgtcccgggtcccttccccggttacgggccctactccggtacgggttccgggggcccgttacccggggtaccgaggtacgtgggaacggtcgttaagtaaatttacgttaacgtcgggttacgtaccggttaaggtttacgggggacttcggtacccggttaagttcccgggtagggttaaccggggttccgggttaccccgggggttaacggggtttccgggggttaccgggggaccggggttaaaccgggggaacccgtacgggttaccggttaccggtaccccgggttaacccggtacgggttaccgaacccggaccccggtaacgggtcccccttcccggtcccccccggtttaaggtacccccttaccgtccccggtttaccccgtacccccggttcccccg

SEQ ID NO: 336387 - DNA, 669 bp, Homo sapiens
  misc_feature: GZ8MTXP02FXA5K.25.34.D01.1.454.CMB.2.raw
  modified_base (325)..(325): a, c, t, g, unknown or other
  misc_feature (325)..(325): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtgccttgggacagacagtcaggatcacatcgaccaaggagacagccctagaagaagcttaattagtgacaagctaggtaccagacaagaacgccgaggacctacggcccctgtactttgtctatactaagtaacggtaaaaaccncccggtcctacgacggtactacccgacgaccgtacttctacccgtcggcctacacgtcctacgaaacgggaaccacgtacgttacctttaccgtacgaaccctagtaccgtacggtacggggccctaggaacggggacgaaagtagtggacgtacgtactaacgttacttaaccggtaccgttaaccggacccgggactacggtaccgtaaggttaaccggtaaacctaagtttaaacttgtacgttacgttaacggaacgttacggaacgtaacgtccgaaccgttactaccggaccacggacccaacggaccccaaacgtcgtactcctacctcgttccccg

SEQ ID NO: 336388 - DNA, 558 bp, Homo sapiens
  misc_feature: GZ8MTXP02GNK76.25.34.D01.1.454.CMB.2.raw
  modified_base (208)..(208): a, c, t, g, unknown or other
  misc_feature (208)..(208): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (478)..(478): a, c, t, g, unknown or other
  misc_feature (478)..(478): n is a, c, g, or t
  modified_base (523)..(523): a, c, t, g, unknown or other
  misc_feature (523)..(523): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgtgctactttgaccttgtctcttggtaccaacaacacccggacaaaggctaccaaactcataattttgagaccagtaagcggaccctntggggtttctagtcgattcactggctcaagtctgcacncggcctccacaatctctgggctcaggctagaagacgaggtcttgtttattcngtctgttnctatgtggctagaaaactagtttggngacttcgggacggacgggaccctaagttcgaaccgttnttaaacgtcaacgcccaaacgggtcttccggccccctgggtaccncgttccgtcgttccccggccctcctacgtaccttg

SEQ ID NO: 336389 - DNA, 592 bp, Homo sapiens
  misc_feature: GZ8MTXP02IP8BB.25.34.D01.1.454.CMB.2.raw
  modified_base (190)..(190): a, c, t, g, unknown or other
  misc_feature (190)..(190): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (431)..(431): a, c, t, g, unknown or other
  misc_feature (431)..(431): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccacctcagtgtctcggggaccccggnaggagggtctccatctnttgttctgggancagctccggagtcggaaattagtttgctactggtaccagcagcctcccaagaaaccggccccaagcctctcatctaagtaggaatgatcagccgccctgaggactacctgactattcncgngtctacgagtcngcctcgtccgcctccgtcgcatcgaggtcgcctccggacgaggactggacggtcttaagaattacgtttacgtgtacgngtttaggttaggggcttacggcccgtaggtctaggggtacgtcgggtacccggtggtcggttcggggacgggtaacggacaagtccgtacggtcccgttcgacgtccgacgtacccgaggcctcccgccccgtacgtccaccgtcctcccttacccgaccc

SEQ ID NO: 336390 - DNA, 553 bp, Homo sapiens
  misc_feature: GZ8MTXP02IM44L.25.34.D01.1.454.CMB.2.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
tcagactgtacagtcacgaccggtgctcgatttagatcgtctgtgagggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacggtcaatcacctatttccngcactggaaccngcactgatgtggcttacttgaccttgtctcttggtaccaacacacccganaagctcaaactcataattttgagacagtaagcgccctcgttggggttctagtcgattcactggctccaagtctggcaacncggccctcctacatctcgtggctcgagctagagacgngtcttgtttattctgtctgttnctagtgtggactagaaactagtttgggtcncgtcggcgggacggtacctaagttcgaccgtacttaacgtcgacgacccggaagccgtccgtacccccgtccgtaccgcgttccgttccgtccccgccctcctaccactttacg

SEQ ID NO: 336391 - DNA, 605 bp, Homo sapiens
  misc_feature: GZ8MTXP02IJ53B.25.34.D01.1.454.CMB.2.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (288)..(288): a, c, t, g, unknown or other
  misc_feature (288)..(288): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctccgtggacgtcaatcacctattccngcactggaaccngcactgatgttgcttacttgaccttgtctctgtacaacacaccgacaagcacaatctatatttganacagaacgcgcctgtggttctagtcgtatcactggctacgaacgtctagcaacacgccttacctacaactctcgtacgcctcgagtcagaagacgtagtcttagtttattctgtctgtctatagtgtagtataagtaaaactagttgggtacgtcgtacgggacggtaacgggaccctaagtaccgtaccgttaacgttaaacgtccgtacgacccgtaaacggtcccgtcccgtcccccgttaaccggttccaacccgtttcccggttcccgttaccccccgaacccctttcccgtaccttaacccgtttaaccgg

SEQ ID NO: 336392 - DNA, 563 bp, Homo sapiens
  misc_feature: GZ8MTXP02IVXFY.25.34.D01.1.454.CMB.2.raw
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggtttctctgagctgactcaggaccctgctgtgtctgtggccttgggacagacagtcaggatcacatgccaaaggagacagcctcagaagctatangcaagctggaccagacagaacgccggacacggcccctctacttgtctcgtaacggtagaaaacnctcgcccctanagggatctcagaccgattcnctgctccgcctcgaagaacncagcttcctagacctancacgtcgggctacgaggcgacgaagagtgaggctagacctattactagtaaacgtcccgggactagacagtacgtaaaccaagtaacttatagttcgttacgaacgtacgggacccgtaaggtccgaccgttaaccgtacggtaccacgaccccaaggaccccaacccactgtaccaaccgttcttaccccg

SEQ ID NO: 336393 - DNA, 700 bp, Homo sapiens
  misc_feature: GZ8MTXP02GFGW2.25.34.D01.1.454.CMB.2.raw
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
tcagactgtacagtcacgaccggtgctcgatttagatcgtctgtggaggggggggtcacaagaggcagcgctctcgggacgtctccaccatggcctgggctctgctgctcctcactcctcctcactcaggacacagggtcctgggcccagtctggcctgactcaacctgcctccgtgtctgggtctccgtggacggtcaatcacctatttcctgcaactggaaccngcactgatgttagcttacttgcttgtctctgtaacaacacgaccganaacgcacaactactataatttnacgtacagtacgccgtcctacgttgggttactagtcgtacttctacgtcggtacctcgtaacgtcgtacggaccaaccgaccggtaccccttaacccgtaactactcttccggacgggccctacggaacggcttaacgggaaacgtacggtacgttacgtttaggtttaccctttcgtacgttcgttacgttcgtacttagttacgggttacgtaacgttaaaacgttaaacgttggtttaccggtcggtaccggtacggggtaaccggggtaacgtaaaccgttagttaccgtaacgttacggtaacgtaccgtaaccgccggtaaccgtcccgttaccgtaccccgtaccgttactaaccgtttcccggtaccttaccccctacctaccttcgtaacgttacg

SEQ ID NO: 336394 - DNA, 510 bp, Homo sapiens
  misc_feature: GZ8MTXP02FRTFQ.25.34.D01.1.454.CMB.2.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtgtttcttctgagctgactcaggaccctgctgtgtctgtggccttgggacagacagtcaggatcacatgccaaggagacagcctcagaanctattangcaagctggtaccagcagaagcccaggacaggcccctgtactttgtcatctataggtaaaaaaccacccggccctcagggatccccagccgatttcncctggctcagctcaggaacncagcttcctnaccatcactggggctcgaggcgaaagntgaggctgacttattacngtaaactcccgganagcagtgtaaaccattaatangtcttcgaactgggaccaggtcaccgtctagtcagcccaagcccaacccctacngtcactcgtcc

SEQ ID NO: 336395 - DNA, 722 bp, Homo sapiens
  misc_feature: GZ8MTXP02GW7A3.25.34.D01.1.454.CMB.2.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
tcagactgtacagtcacgaccggtgctcgatttagatcgtctgtgttgggtttggggagagaagacaggattcaggacaatctccagcatggccggcctccctctcctcctcaccctcctcactcactgtgcagggtcctgggcccagtctgtgctgactcagccaccctcagtgtcgtcggggacccccggnaggagggtcctccattctcttgttcgngggancagcctccgacgtacggaaattagtttcgtctactcggtaaccngcaagccctaccgaacgaaacccggcccccaagcctccnatctataaggatgactcgacggccggtacccctggaagggtactacccgtaggacccgtatttcctcgtcgggtcctaccggtaacgtccgtcgggtcccttccccggtccggtacccccttcccggtcgggtaccctaacgttccgggtaggggttccgggccccggtttcccggggtacccggaggggtacgttcgggaaacgggtccgttaaggtaaactttacgttaccgttggtacgtacgttagggtttggtacgtcgtcgtagtcgtagggcggttacggtccggtagggttcgtccgggggacggacggggtaaccaggtccgtacggtacccgtcgtaacggccacggacccggagtcccgtccgacccccgtggtacctccgtccgtacccggtaccctccccg

SEQ ID NO: 336396 - DNA, 626 bp, Homo sapiens
  misc_feature: GZ8MTXP02I1HZO.25.34.D01.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagactgtacagtcacgaccggtgctcgatttagatcgtctgtgttgggtttgggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggnacagccctnaagaagcttaattacngacaagcttggaccagcagaagccaggacaggcccctgtacttgtcatctaagtaacggaaaaacaccggaccctacgagggactcccgaagaccgatctacctggacctccagctcaacggaaccacgacgtacttcctcgacatcgacgtgggctacgagacgaagatgagatacgactattacgagtaaccgtccggaacacgtaccgtaagtacggttaaaccaattaaacgttgtacgttacgttaacggtaacgtacggtaaaccgtaacggtccgtaaacccgttacccgttaacggtacccgtaacgaacccggaaaccggacccccttaaaaccccgaccgttacgtaccctaaccgttacgtttacccccgg

SEQ ID NO: 336397 - DNA, 648 bp, Homo sapiens
  misc_feature: GZ8MTXP02JCISK.25.34.D01.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (344)..(344): a, c, t, g, unknown or other
  misc_feature (344)..(344): n is a, c, g, or t
tcagactgtacagtcacgaccggtgctcgatttagatcgtctgtgttgggtttggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggngacagcctcagaagctatangcaagctggaccagcagaanccagacnggccctgattgacatctanaggtaaaacaccggcctacaggactccagaccgattcnctcgctccagctacgagaaccncgacgtccttccgtacacctataccgacgtcgggactacgaagggacggaaagtacggtacggaacgtcgtacgtacgttaacgtttaaccgtacggtaaacccgtacccggggaactacggtacgtaacggttaaacgtaaaccttaacgttaaacgtttacgttacggttacgtttaacgggaaaccggtttacgggaaaccctaaaacgggtccgtaaccccggttaacgttacgggtaaccaccggtaacccgaaaccgacccctaaacccgtccgtacgtaccgtaccgttccgtaccg

SEQ ID NO: 336398 - DNA, 574 bp, Homo sapiens
  misc_feature: GZ8MTXP02FFDFA.25.34.D01.1.454.CMB.2.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (302)..(302): a, c, t, g, unknown or other
  misc_feature (302)..(302): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccngcactgatgttggctactttgaccttgtctcttggtaccaacaacacccggacaaaggctaccaaactcataattttganaccagtaagcgccctctggggttctagtcgattcactggctcaagtctggcaacacggcctcctacaatctctgggctcagctagaagacgaggcttgtttatttcngctgtgactatgtggctagaaaactagtttgggngcgtcgggacggtacggggaacccctaaagtcgtaccggtacttaaaacggtcacggcccaaagggcctaccggtaccccccgtggtcaaccgttcgtaccgttccccaacccctttccactacgtttacg

SEQ ID NO: 336399 - DNA, 680 bp, Homo sapiens
  misc_feature: GZ8MTXP02HDJJ7.25.34.D01.1.454.CMB.2.raw
  modified_base (209)..(209): a, c, t, g, unknown or other
  misc_feature (209)..(209): n is a, c, g, or t
  modified_base (274)..(274): a, c, t, g, unknown or other
  misc_feature (274)..(274): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacgtcaatcacctatttccngcactggaaccagcatgatgttcgcttatttgaccttgtctctacggtaccaacaaccgaccganaacgctacaactctattaatttagacaccgtaaggtacgccggtcccttcggttgggttactacgtcgtacttaccgtacgtcggtaccttacgtaaccgtcgtacggaaccgtaaccgaccggtaccctaacccctaactaacgttccgtacgtacggggtccctaccggacgggtacgttacggaaacgtaccggtaacgggtcctttaggttttacttcgtacgttcgttgtttacgcgttagttggtacggtactaaggtaaaacttaggtttgggacgtcgtacggggacgtacggacttagtacgtacgttcttaaagccgacgtaccgacggtcctaccgtccccgtgtaccctccgttccgtacccggttccctaccccttcgtacgtacgtttaccg

SEQ ID NO: 336400 - DNA, 783 bp, Homo sapiens
  misc_feature: GZ8MTXP02HYLKP.25.34.D01.1.454.CMB.2.raw
  modified_base (243)..(244): a, c, t, g, unknown or other
  misc_feature (243)..(244): n is a, c, g, or t
tcagactgtacagtcacgaccggtgctcgatttagatcgtctgtgttgggtttgggggctcagaagcagagttctggggtgtctccaccatggcctggaccccctctctggctcactctcctcactctttgcataggttctgtggttttcttctgagctgactcaggaccctgctgtgtctgtggccttgggacagacagtcaggatcacatgaccaaggagacagcctacagaagctattanncaagctaggaccagcagaagccaggacacggcccctgtacttgtacatcctaagtaacggtaaaaaccaaccggtccctacgaggggtacctaccccgaagacccgtatttaccgtcccgttcggcccttacccgaacggtccttaccgaaacgggaaaccgaccgtaaccgttccctttaccccgttaacggaccctaacgttaccgtaaccggtcgggggtacccttccggaacggggtaccgggaaaagttaaggacgggtaaacggggccttaccgggtaaaattaccgtttaaaccggtccgttaaaaccgggttccccccgggaaagtaccggtaccgtaacggttaaacggtaaacccaagtttaaaacttacggttacgtaccggttaccgtaaaacgggttaccggaaccggtaaaccggttaaccggtcccgttaaacccgtaacggggttaccgaacccgtacccccggaaacggtaaccccgtaaacccccaacggtcccgtaccctaccgtttccgttacccccgg

SEQ ID NO: 336401 - DNA, 660 bp, Homo sapiens
  misc_feature: GZ8MTXP02FJYN6.25.34.D01.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
tcagactgtacagtcacgaccggtgctcgatttagatcgtctgtgttgggtttggggagagaagacaggattcaggacaatctccagcatggccggcctccctctcctcctcaccctcctcaatcactgtgcagggtcctgggcccagtctgtgctgactcagccaccctcagtgtctgggacccccgggnagagggtctccatctcttgttctgggancagctccgacgtcggaaataagttgtctatggtaccagcagctccagaaaccgccccaagctccncatctanaggatgatcagcgccctgagggatacctgaccgtattcctcgtggctccgaagtcnggcctccgtccggccctcccgtggcctagtccaggtcgggccttccgggtccgaggtacgtggacggtctagaaattagtttacgtgtgtacgtaggtttaggggatggccctaggttccttagggtaggttccgggttaccggtaacggggtttcgggttccggggcggggtaaacgggggaacctaacgggtaccgtcggtaaccccggttcggttaacggtaccggaaccggaccccgtaaagggtccccgtccggccccccgttcggggacccttaccgttcccgtaccggtttaccccccttcccccg

SEQ ID NO: 336402 - DNA, 675 bp, Homo sapiens
  misc_feature: GZ8MTXP02FLRI3.25.34.D01.1.454.CMB.2.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
tcagactgtacagtcacgaccggtgctcgatttagatcgtctgtggaggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacatttcctgcactggaaccngcactgatgtgctattcgacttgtctnttcgtaccaacacaccgaacaagcaccaacnctaattaatttganacagtacgcgtcctgtcgggttctagtcattcactgctcaagtcngacacacgccacctanactctcgtcgacctcgagtctacgaagtaaccgnggtactttagttttaagttttccgngtccgttggttacgtacgttaggttcggttacggtaacttaaacggtaaaaaactttaggttttaggggttacgtccgggttacgggggtacgggaaccgggtaaaccgttaaacggttacggttaaaccgttaacgtaaaacgggttccgaaaaccggtacccggaaacgggtccccgttcccggttaacccccggtccgttaccgtaaccgttcccgttcccggttccccctcccgttaccctaccgtacgtttaaccgg

SEQ ID NO: 336403 - DNA, 534 bp, Homo sapiens
  misc_feature: GZ8MTXP01EEN03.45.72.G06.1.454.CMB.2.raw
  modified_base (315)..(315): a, c, t, g, unknown or other
  misc_feature (315)..(315): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccaccctctcctgctgggccagtcagagtgttagcaaccacttagcctggtaccagcagaaacctggccaggctcccagactcctcatttatggttctctaccagggccnctggtatccccagcccaggttcagtgccaggtgggtcctggggacaggtagttcaacttctcaccatcagcagcctgcagtctgaagtatttgtctagttttatttctgtcagtctagtatcataactggctgtactagtttggccgtaggggaccaagcgtaaggaaattacaaacgaacgtgtgcgttgcaaccatctgtcttctaacttcttcccg

SEQ ID NO: 336404 - DNA, 523 bp, Homo sapiens
  misc_feature: GZ8MTXP01A5NIO.45.72.G06.1.454.CMB.2.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagagccacctctcctgctgggccagtcagagtgttagcaaccacttagcctggtaccagcagaacctggccaggctccagactcctcatttatggttctctaccagggccnctggtactcccagccaggttcagtcgccagtcggtcctggggacagngttcaactctcaccatcagcagcctgcagtctagaagtatttgactagttttattctgttcagtctagtatcatactggctgtactagtttgcgtaggggaccagctaaggaaacttcaaacgacgtgtggcttgcaacctatctgtcttctaacttccgttcccg

SEQ ID NO: 336405 - DNA, 523 bp, Homo sapiens
  misc_feature: GZ8MTXP01D2RQ2.45.72.G06.1.454.CMB.2.raw
  modified_base (372)..(372): a, c, t, g, unknown or other
  misc_feature (372)..(372): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
tcagacgcgatcgacacgaccggtgctcgatttagctacgactgcaagggaaagggtctctgaagccttcagagaccctgtccctcacctgcactgtctctcgtgggtccatgagaagtgactactggagttggatccggcagcccccagggaagggcctggaatggattggctttgtctattatactggggtcaccaattacaaccctcctcaagagtcgggtcaccatttcggtcgacacgtccaacagcctgttctccctgaaggtgcattctgtgaccgctgcggactcggccgtgtattactgtgcgagaatcgatgagagtgctggttattactatggttactttcgactcgtggggccagggganccctggtcaccgtctctcagcttcacaaggccatcggtctccctgcgcctgctcagagcaccgtcgtgggggcacgagccggcccgtgggcctgcctggtcaaggaactacttcctcgatcgcttcgttgagcggcgngcgagcgcgngng

SEQ ID NO: 336406 - DNA, 525 bp, Homo sapiens
  misc_feature: GZ8MTXP01EN2GE.45.72.G06.1.454.CMB.2.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgctgggccagtcagagtgttagcaaccacttagcctggtaccagcagaaacctggccaggctcccagactcctcatttatggttctctaccagggccnctggtatcccagcccaggttcagtgccaggtggtcctgggacagagttcaactctcacatcagcagcctgcagtctgagtatttgtactagtttattctgtcagtcagtatctataactgtctgtacgtagtttggccgtaggggaccaagctaaggaaattacgaaacgagtgtggcttgcaacatctgtcttctaacttccgttccc

SEQ ID NO: 336407 - DNA, 518 bp, Homo sapiens
  misc_feature: GZ8MTXP01EPPD9.45.72.G06.1.454.CMB.2.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (502)..(502): a, c, t, g, unknown or other
  misc_feature (502)..(502): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagngccaccctctcctgctgggccagtcagagtgttagcaaccacttagcctggtaccagcagaacctggccaggctcccagactcctcatttatggttcttctaccagggccnctggtatcccagccaggttcagtnccagtggtcctgggacagngttcaactctcaccatcagcagcctgcagtctgaagtatttgctagtttattctgtcagcagtatctataactggctgtctagtttgcgaggggtaccaagctaaggaaattacgaaacgacgtgtgcttgctaaccattccgtntcttctcttccgtccg

SEQ ID NO: 336408 - DNA, 521 bp, Homo sapiens
  misc_feature: GZ8MTXP01AKD0Z.45.72.G06.1.454.CMB.2.raw
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (364)..(364): a, c, t, g, unknown or other
  misc_feature (364)..(364): n is a, c, g, or t
  modified_base (502)..(502): a, c, t, g, unknown or other
  misc_feature (502)..(502): n is a, c, g, or t
tcagacgcgatcgacacgaccggtgctcgatttagctacgactgcaagggaaagggggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaacacttagcctggtaccagcagaacctggccaggcncccagactcctcatttatggttcttctaccagggccntggtatcccagccaggttcagtgccagtgggtctggggacagagttcacttcncaaccatccagccagccctgcagtctagaagtattttgcttagtttatttctgtcagtctagtatctaataactggctgtactagtttggacctaggggaccaagctaggaaatcaaacgacttgtaggcttgcaccntctgtctcatccttcccgc

SEQ ID NO: 336409 - DNA, 571 bp, Homo sapiens
  misc_feature: GZ8MTXP01DJZAN.45.72.G06.1.454.CMB.2.raw
  modified_base (364)..(364): a, c, t, g, unknown or other
  misc_feature (364)..(364): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagactcctcatttatggttcttctaccgagggccgctggtactcccagcccaggttcagtgccaggtggtcctggggacngtagtcaactctcaccatcagcagcctgcagtctagaagtattttgacttagttttattcgtgtcagtctagttagtctaagttaactggtcttgtactaggttttacggccgtaggggtaaccaaggtcgtaaggaaacttacgaaaacgttaacgtggtgggttcttggacctaacctatccttgtccttctaacttccttcccg

SEQ ID NO: 336410 - DNA, 522 bp, Homo sapiens
  misc_feature: GZ8MTXP01B6TK4.45.72.G06.1.454.CMB.2.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaacctggccaggctcccagactctcatttatggttcttctaccagggccnctggtatccccagcccaggttcagtgccaggtgggtcctggggacaggtattcaactctcaccatcagcagcctgcagtctgagtatttgctagtttattctgtcagtcagtatctataactggtctgtactagtttggcgtagggaccagctaaggaattacgaaacgacgtgtgcgttgcaacatctgtcttctaacgttcgttccc

SEQ ID NO: 336411 - DNA, 520 bp, Homo sapiens
  misc_feature: GZ8MTXP01APU6L.45.72.G06.1.454.CMB.2.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
  modified_base (499)..(499): a, c, t, g, unknown or other
  misc_feature (499)..(499): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgctgggccagtcagagtgttagcaaccacttagcctggtaccagcagaaacctggccaggctcccagactcctcatttatggttcttctaccagggccnctggtatcccagccaggttcagtgccaggtggtcctggggacagagttcaactctcacatcagcagcctgcagtctagagtatttgactagtttattctgtcagctagtatctataactggctgtactagtttggccgtaggggaccagctaaggaaattcaaacgacgtggtggcttgacaacntctgtcttctcgttcttcccg

SEQ ID NO: 336412 - DNA, 599 bp, Homo sapiens
  misc_feature: GZ8MTXP01DWTBF.45.72.G06.1.454.CMB.2.raw
  modified_base (373)..(373): a, c, t, g, unknown or other
  misc_feature (373)..(373): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagagccaccctctcctgctgggccagtcagagtgttagcaaccacttagcctggtacccagcagaaacctggccaggctcccagactcctcatttatggttcttctaccgagggccgctggtatccccagcccaggttcagtcgccagtgggtcctgggacagagttcaactntcacatcagcagcctgcagtctagaagtattttgacttagttttattctgtcagctagtatctaattaactggtactgttacgttaggttttcgggaccgtaagggggtaacccaaggtccgtaaagggtaaacttaccgtaaaacggttaccgttagggtacgggttcgttcggttaccaaccctattcgtttacgttcctttactaacgtttcccgtttccccg

SEQ ID NO: 336413 - DNA, 544 bp, Homo sapiens
  misc_feature: GZ8MTXP01B1KCI.45.72.G06.1.454.CMB.2.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaacacttagcctggtaccagcagaaacctggccaggctcccagactcctcatttatggttccttctaccgaggggcccgctggtactccccgagccctaggttcaggttcgccgaggtcgggtccctggggacaggtagttcaactctcaccatccagcagcctgcagtctgagtatttgctagtttattctgtcagctagttatctataactggtctgttactggtttggccgtaggggaccgaagcgtaaggaaattacaaacgaacgtgtggcttgcaacatctgtcttctcttcttcccg

SEQ ID NO: 336414 - DNA, 547 bp, Homo sapiens
  misc_feature: GZ8MTXP01C6FSI.45.72.G06.1.454.CMB.2.raw
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaacctggccaggctcccagactcctnatttatgttcttctaccaggccntggtactccccagcccaggttcagtgccaggtgggtcctggggacagagttcaactctcaccatcagcagcctgcagtctagtaagtattttgacttagttttatttctgttcagtactagtatctaattaactggcttgtactaggttttcggccgtaggggaccaagcgtaagggaaacttacgaaacgacgtgtggacttgacaaccatctgtcttctaacttccttcccg

SEQ ID NO: 336415 - DNA, 601 bp, Homo sapiens
  misc_feature: GZ8MTXP01DM1K8.45.72.G06.1.454.CMB.2.raw
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagactcctcatttatggttcttctaccagggccncgtggtactccccagcccaggttcagtcgccaggtgggtcctggggacagagttcaactctcgaccatcagcacgcctgcagtctagaagtattttgacttagttttatttcgtgtacagctagttatctaataacctggcttagtacgtaggtttcggccgtaggggacccaaggccgtaaggaaacttacgaaaacgttaacgttggtggttaccgttggaccctaaccggtaactttccgttcggttaccctttaccgtaactttcccgtttaaccccccgg

SEQ ID NO: 336416 - DNA, 583 bp, Homo sapiens
  misc_feature: GZ8MTXP01BE39A.45.72.G06.1.454.CMB.2.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagngccaccctctcctgctgggccagtcagagtgttagcaaccacttagcctggtaccagcagaaacctggccaggctcccagactcctcatttatggttcttcaccgagggccnctggtactccccagccctaggttcagtcgcctaggtgggtccctggggacnggtacgttcaactctcacctatccagccagcctgcagtctagagtatttgacttagtttattctgtcagtactagtatactataactggtctgtacgtagtttcggccgtagggggtacctaaggcgttaaggaaacttacgtaaaacgttacgttaggtcggttacttcggacctaacctacttaacgttcgttccttactaacgttccttccccg

SEQ ID NO: 336417 - DNA, 614 bp, Homo sapiens
  misc_feature: GZ8MTXP01CAKUZ.45.72.G06.1.454.CMB.2.raw
  modified_base (567)..(567): a, c, t, g, unknown or other
  misc_feature (567)..(567): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagccccagggaaggcctggaatggattggctttgtctattatactggggtcaccaattacacccctcctcaagacgtccgggtcacatttcggcgaacacgtccaacgacgtccttcgttcctccgtaggtaacggtcgtactacttcgtcgtacgaccgtcgtcggacgtccgtccggtccgtagttacgttaccgttggggtacgtacggaagtaacgtcgtagtaggagtaggtgtcgttaggtttaacttacgtaagtttagtttacgttcgttaccgtcggtcggggaccgngggaccgtccgtcgtaaccgtccgtccttccgtcgttaacgtccccg

SEQ ID NO: 336418 - DNA, 583 bp, Homo sapiens
  misc_feature: GZ8MTXP01D93U9.45.72.G06.1.454.CMB.2.raw
  modified_base (206)..(206): a, c, t, g, unknown or other
  misc_feature (206)..(206): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
  modified_base (369)..(369): a, c, t, g, unknown or other
  misc_feature (369)..(369): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggggaaatactgatgacgcagtttccagccaccctgtctgtgtctccaggggaaagngccaccctctcctgctgggccagtcagagtgttagcaaccacttagcctggtaccagcagaaacctggccaggcncccagactctcatttatgttctctaccaggggccntggtactcccagccaggttcagtgccagtggtctgggacagagttcactctcnccatcagcagcctgcagtctgaagtatttgcttagtttatttctgtcagtctagtactacgtaataactggtacttagttactaggttttcggaccgtagggggtaaccaaggtcgtaagggtaaaactacgaaaacggtaaacgttggtagggacttacggcttaacccgtaattccgttcgttccttacttactttcccgtttcccgtaacc

SEQ ID NO: 336419 - DNA, 624 bp, Homo sapiens
  misc_feature: GZ8MTXP01ALA01.45.72.G06.1.454.CMB.2.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaaacctggccaggctcccagactcctctatttatggttcttctaccgagggccnctggtactcccagcccaggttcagtgcctaggtcgggtcctggggacaggtcgttcaactctcaccatcagcagcctgctagtctagtaagtatttgacttagttttatttctgtcagtctagttatctaattaaccgtgggtacttggttacgttaggttttacgggacccgtaagggggtaaccctaaaggtccgtaaagggtaaaacttaccgtaaaaaccggttaacgttacgggtacgggttacttcggacctaacccgtaattccgttacgttacctttcctaaccgtttcccttcccccg

SEQ ID NO: 336420 - DNA, 605 bp, Homo sapiens
  misc_feature: GZ8MTXP01BY9VM.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgccccccgagggaacggcctggaatggattggctttgtctattatacgtgggtcacctaattacacccctcctcaagcgtcccggtcacgtatttccggcaacacgtccaacacgccttgttcctccctgaacggtcgctattctgtcgacccgctggccgactcggccgtgtattacgtgggtgcgtagaatcgagtggagtagtgtcgttaggtttacttacgttaagtttcggtttactttcggaccgttccgggtcgggggacccgttgggggaccgtccccggttagggtccccgtacccggttccttcccgttcgaacggttccccg

SEQ ID NO: 336421 - DNA, 597 bp, Homo sapiens
  misc_feature: GZ8MTXP01EIQ35.45.72.G06.1.454.CMB.2.raw
  modified_base (201)..(201): a, c, t, g, unknown or other
  misc_feature (201)..(201): n is a, c, g, or t
  modified_base (365)..(365): a, c, t, g, unknown or other
  misc_feature (365)..(365): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgctgggccagtcagagtgttagcaaccacttagcctggtaccagcagaaacctggccaggcctcccagacctcctctatttatggttcttcaccgagggcctctggtactcccagccctaggttcagtcgcgaggtgggtcctggggacngagttcaactctcaccatcagcagcctgcagtctagaagtatttgacttagttttattctgtcagtctagtatactaattaacgtggtacttgttacgttaggttttacggaccgtaagggggtaaccctaaaggcgttaaagggtaaaacttacgaaaaccggttacgtgggtacggttcttcggacctaacctagttccttgttccttacctaacgtttcccgttccccg

SEQ ID NO: 336422 - DNA, 532 bp, Homo sapiens
  misc_feature: GZ8MTXP01AVGVW.45.72.G06.1.454.CMB.2.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgctgggccagtcagagtgtagcaaccattagcctggtaccagcagaacctggccaggctcccagactcctcatttatggttctctaccgagggccnctggtatcccagccaggttcagtgccagtggtcctgggacaggattcaactctcaccatcagcagcctgcagtctgagtatttgactagtttattctgtctagctagtatctatactggtctgtactagtttggcctaggggactaagctaaggaaattacgtaaacgacgtcgtggcgttgacctaaccattccgtgtccttctaacgttccttccccg

SEQ ID NO: 336423 - DNA, 723 bp, Homo sapiens
  misc_feature: GZ8MTXP01DWA9B.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagagtgactactggagtggactccggcacgcccccgagggaaggccgtaggaatggattggtctttgtctattagtacgtgggtacacctaaacttaccaacccctccctacaaagacgtcccgggtaccacgtagtttccggtaccgaaaccgaaccgtcccaaacgtacggtcccttacggtttccctaccccgtagggtaaacgtcgtacctaacttcgtggtacgtacccggtcgttcggacccgggtaccgtccgggtacccgttgttaaacgtttaccgtgggggttcgaccggtaaagtaaagttccggaaagttggaaggtaaggttcggtccgtttaagggtttaactttaacgttaagttttcgggttttaaactttcggttaccgttcccggttacgggggacccgttagggggttacccgtcccggtcgtcccggtacccgtccgttaccttccgaaccgttaaccccg

SEQ ID NO: 336424 - DNA, 524 bp, Homo sapiens
  misc_feature: GZ8MTXP01DMAVX.45.72.G06.1.454.CMB.2.raw
  modified_base (215)..(215): a, c, t, g, unknown or other
  misc_feature (215)..(215): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctnacctgcactgtctctcgtgggtccatgagaagtgactactggagttggatccggcagcccccagggaaggcctggaatggattggctttgtctattatactggggtcacaattaccaacccctcctcaagagtccgggtcacatttcggtcgaacacgtccaaacagcctgttcctcctgaagtgcattcngtgaccgctgcgactcggccgtgtattactggtgcganaatcgatgagagtgctggtatctaatggttacttgactcgtgggccngggacnccctggtcaccgtcttcctcaagtccc

SEQ ID NO: 336425 - DNA, 527 bp, Homo sapiens
  misc_feature: GZ8MTXP01ANX31.45.72.G06.1.454.CMB.2.raw
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccaccctctcctgctgggccagtcagagtgttagcaaccacttagcctggtaccagcagaaacctggccaggctcccagactcctcatttatggttctctaccagggccntggtactcccagcccaggttcagtgccaggtgggtcctggggacagtacgttcaactctcaccntcagcagccctgcagtctgaatatttgctagtttattctgttcagctagtccggttccgccacgccgtctcgtacgtttcgggcgggggtctaggggtgagntggagagacgttggtcgnttcgcacngtctgtctcactccttccgc

SEQ ID NO: 336426 - DNA, 556 bp, Homo sapiens
  misc_feature: GZ8MTXP01EBWR2.45.72.G06.1.454.CMB.2.raw
  modified_base (412)..(412): a, c, t, g, unknown or other
  misc_feature (412)..(412): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgcccccagggaagggcctggaatggattggctttgtctattatactggggtcacctaattaccaacccctccctcaagagtccggtcactatttcggtcgaaccacgtccaacacgcctgttctccctgaagtgcattcngtgaccgctgcgactcggccgtgtattacgtggtgcgagatcgatgagagtgcttggttattactaattggtttactttgttacgtccgtggggcccgttgggaccgtccgtcggtccaccggtcttcccgttcgaacgttccc

SEQ ID NO: 336427 - DNA, 565 bp, Homo sapiens
  misc_feature: GZ8MTXP01CNIAI.45.72.G06.1.454.CMB.2.raw
tcagacgcgatcgacacgaccggtgctcgatttagctacgactgcaagggaaagggtctctgaagccttcagagaccctgtccctcacctgcactgtctctcgtgggtccatgagaagtgactactggagttggatccggcagcccccagggaagggcctggaatggattggctttgtctattatactggggtcaccaattacaacccctcctcaagagtcgggtcaccatttcggtcgacacgtccaacagcctgttctccctgaaggtgcattctgtgaccgctgcggactcggccgtgtattactgtgcgagaatcgatgagagtgctggttattactatggttactttcgactcgtggggccagggaacgccctggcaccgtctcctcacgcttcccaccaacgggcccacgtccggtccttccccctggcccgccctcgcctccgaggacgccgaccggtcgtcgggggccacgacgccggcccgtgggctcgtccgtggtcaagggaactacgttccgtcgacgtcgtcgttcgttgcggcggctggcaggcgcaagtg

SEQ ID NO: 336428 - DNA, 618 bp, Homo sapiens
  misc_feature: GZ8MTXP01C9833.45.72.G06.1.454.CMB.2.raw
  modified_base (252)..(252): a, c, t, g, unknown or other
  misc_feature (252)..(252): n is a, c, g, or t
  modified_base (378)..(378): a, c, t, g, unknown or other
  misc_feature (378)..(378): n is a, c, g, or t
  modified_base (412)..(412): a, c, t, g, unknown or other
  misc_feature (412)..(412): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagcccttcagacgacccctgtcccctcacctgcactgtctctcgtggtccatgagaagtnactactggagttggatccggcacgccccgagggaaggcctggaatggattggtctttgtctattatacgtgggtcactaataccaccctcctcagcgtccggtcactgttcgcgaacacgtcaacngcctgtctcctagacgtgctattctgtcgaccgngtcggcggtaccgtcgggcgttagttactttaccgtggggttcggaccgtaagtaaccgttgagtggaaggtagtcgtagtttgggtttaactttaacgttaagtttgggttttaacttttcgaaccgtttccgggttcgggggacccgttagggggttaccgtcccgttagggtccctaccggtccttccgtcgaacggttcccc

SEQ ID NO: 336429 - DNA, 533 bp, Homo sapiens
  misc_feature: GZ8MTXP01ANSF0.45.72.G06.1.454.CMB.2.raw
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (529)..(529): a, c, t, g, unknown or other
  misc_feature (529)..(529): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtggtccatgagaagtgactactggagttggatccggcacgcccccgagggaaggcctggaatggattggctttgtctattatacgtggggtcaccaattaccaacccctcctcaagagtccggtcactatttcggcgaacacgtccaaacacgcctgttctccctgaacggtgctattctgtgaccgctgcggactcggccgtgtattacgtggtgcgagaatcgatgagagtgtctggttattctaatgtttacttgacgtcgtgggccgngggncccgtgctccgtcttcctcncgtc

SEQ ID NO: 336430 - DNA, 583 bp, Homo sapiens
  misc_feature: GZ8MTXP01CD72J.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccgagggaagggcctggaatggattggctttgtctattatacgtggggtcaccaattaccaacccctcctcaagagtccgggtcactatttcggtcgaacacgtccaacacgcctgttctccctgaacgtgctattctagtcgaccgtctcggcggacgtcggccgtgtattacgtgggtgcgagatcgatgagagtgtcgttaggtttattactaagttcggtttactttcggacgttccgtgggggttccgagggggttaccgtcccgttggggtcccacccggttcttccctccgaacgttcccc

SEQ ID NO: 336431 - DNA, 536 bp, Homo sapiens
  misc_feature: GZ8MTXP01EYRQA.45.72.G06.1.454.CMB.2.raw
  modified_base (416)..(417): a, c, t, g, unknown or other
  misc_feature (416)..(417): n is a, c, g, or t
  modified_base (501)..(501): a, c, t, g, unknown or other
  misc_feature (501)..(501): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatcggcagcccccagggaaggcctggaatggattggctttgtctattatactgggggtcaccaattaccaacccctccctcaagacgtccggtcactatttcggtcgaacacgtccaacagcctgtctccctgaagtgcattctgtgacccgnngcggactcggcctgtatactggtgcgagaatcgatgagagtgtctggttattctaatggttacttgttacgtccgtggggccgngggacgccgtggtccaccggtcttcctcgcgtccc

SEQ ID NO: 336432 - DNA, 654 bp, Homo sapiens
  misc_feature: GZ8MTXP01EU3BP.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagaagtgactacgtggagtggactccggcacgccccgagggaacggccgtaggatggtattggtctttgtcttattatacgtgggtacaaccgtaacttaccaacccctcctacgaaaggtacgtcccggtcctacgtagtttccggtaccgaaaccaccgtccaaacacgtcccttcgttccctcccgtagtaacgggtcgactattcgtgtcgacccgtcgtcggaccggtaccgtcggtccgttgtacttacgtgggtcgacgtaagaactcgatggagtagtcgtcgttaggttacttacgtaagtttggtttaacgtttcggttaccgttccgggtcggggaccgttacggggttccgtccccgttggttcccgacccggttcttacccgtcgttaacggttccccg

SEQ ID NO: 336433 - DNA, 607 bp, Homo sapiens
  misc_feature: GZ8MTXP01AU3HX.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagagtgactactggagttggatccggcacgcccccgagggacggctggatggatggtctttgtctattatacgtgggtcaactaattaccacccctcctacaagacgtccggtcactacgtttcgtcgaacaccgtcccaaactacgtcctcgttcctcccgtgaacgtgctattcgtgtcgacccgtctcggccggtactccgggccgttgtaattcgtgggtgcgaagaatcgagtgaggtagtgtcgttaggtttacttcgttaattcggtttactttgaccgttccggtggggttacccgttaggggttccgtcccggttggtcccgtacccggttccttcccggttcaaccggtttccccg

SEQ ID NO: 336434 - DNA, 714 bp, Homo sapiens
  misc_feature: GZ8MTXP01BRE2N.45.72.G06.1.454.CMB.2.raw
  modified_base (202)..(202): a, c, t, g, unknown or other
  misc_feature (202)..(202): n is a, c, g, or t
tcagacgcgatcgacacgaccggtgctcgatttagctacgactgcaagggaaaggggggaactgctcagttaggacccagacggaaccatggaagccccagcgcagcttctcttcctcctgctactctggctcccagaaaccattggagaaatactgatgacgcagtttccagccaccctgtctgtgtctccgaggggaaancgccaccctctcctgctgggccagtcagtagtgtagacaacctacttagcctggtaccagacaagaaacctggacccaggcctcccagacctcctactatttatcggtttccttcgacccgaggggtccctcgttcggtacctccccgagtcccgtagggtttccaaggttcgccgtaagggttcggggtccgtaggggacctaggtacgtttccaaccttacctaccaaccgatccgaacgcctacgcccgtagacctagtcgtagtaagttattttacggtattaagttttattttacgttacgttacgtacgtactaagttaacttacgtaaagttaacgttaggtaccgttagttaccgttagggttttacggaaccggtaacggggtaaaccgtaaagtaccgtaaagggtaaaactaaacgttaaaacggtaacgttcggtacggcgttacgaccttaccgtaattccttaacgttccttacgttaccttcccgttccccgtaacc

SEQ ID NO: 336435 - DNA, 651 bp, Homo sapiens
  misc_feature: GZ8MTXP01C907Z.45.72.G06.1.454.CMB.2.raw
  modified_base (386)..(386): a, c, t, g, unknown or other
  misc_feature (386)..(386): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgccccgagggaacggcctggatggattggctttgtctattatacgtgggtcaacctaaattaccaacccctcctacaagacgtccggtcactagttcgtcgaacacgtccaaacncgtacctcgttcctacccgtgtaaacgtcgtactattcgtgtcgacccgcgttcggacggtacgtcggccgttagttacgttacgtgggtacgtacggaagtaacgttcgaagttggaaggtagtcggtcgttaggtttaactttaacttaaggtttcggtttaaccttttggaacccgtttccgggtcgggggttacccgttagggggttacccgtcccgtcgggttccctacccggttccttcccgtccttcggttaaccccg

SEQ ID NO: 336436 - DNA, 577 bp, Homo sapiens
  misc_feature: GZ8MTXP01DZGBB.45.72.G06.1.454.CMB.2.raw
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (404)..(404): a, c, t, g, unknown or other
  misc_feature (404)..(404): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaagagccaccctctcctgctgggccagtcagagtgttagcaaccacttagcctggtaccagcagaaacctggaccaggctcccagactcctctatttatggttctctaccagggccnctggtactccccgagccctaggtcagtcgccaggtgggtcngggacagtagttcaactctcacatcagcagctgctagtctagaagtntttgacttagttttattctgtctagactagtatactattaactggtctgttacgtaggtttacggaccgtaggggtacctaaggtcgtaaaggtaaacttacgaaacgttacgtggtcggacgttgacctaacctattcgttacgttccttactaacgtttcccgtttccccg

SEQ ID NO: 336437 - DNA, 591 bp, Homo sapiens
  misc_feature: GZ8MTXP01EN0AD.45.72.G06.1.454.CMB.2.raw
  modified_base (306)..(306): a, c, t, g, unknown or other
  misc_feature (306)..(306): n is a, c, g, or t
  modified_base (407)..(407): a, c, t, g, unknown or other
  misc_feature (407)..(407): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgccccccgagggaacgggcctggaatggattggntttgtctattatacgtgggggtcaccctaaattaccaaacccccttccctacaaacgacgtccgggtacacctagtttccggtcgaaccaccgtccaaacncgacctcgttcctccctgaaggtgctattctgtcgaccgcgtcgcggactcgggccgtgttaattccgtgggttgcgagaatcgatgagtagtgtcgttggttattactaagttcgtttactttgacttcggtgggccgagggcgtcccgtgtaaccctccgtcttccctcgttaacggtcccc

SEQ ID NO: 336438 - DNA, 616 bp, Homo sapiens
  misc_feature: GZ8MTXP01CXRZM.45.72.G06.1.454.CMB.2.raw
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccagggaagagccaccctctcctgctgggccagtcagagtgttagcaaccacttagcctggtaccagcagaaacctggccaggcctcccagacctcctctatttatggttcttctaccgacgggcccgtctcggtaactccccgagccccgtaggtttccagttcggccgtaggtcggggtccgttggggactaggtacgttccaaaccttccttcaacccaattccaaggccaacgcctagctagtctgtaaagtattttggacttagttttactttctgttacagactagtatctaattactgcttgtacgttagtttcgggacgtaggggtaacctaaggcgtaagggtaaacttacgtaaaacgacgtaggtcgacgttgcctaactatcttacgttcttccgtaacttccgttaaccccg

SEQ ID NO: 336439 - DNA, 589 bp, Homo sapiens
  misc_feature: GZ8MTXP01C9UWW.45.72.G06.1.454.CMB.2.raw
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagacgccaccctctcctgctgggccagtcagagtgttagcaacctacttagcctaggtaccagacagaaacctggaccaggcctccagactcctctatttatgttctctaccgaggccgtctggtactcccagtcctaggttcagtcgccgtaggtcgggtctggggacagtacgttcaactctcacctatcgacgcaggcctgctagtctagtaagttatttgtacttagttttatttctgtctagactagtatactaattaacgtcgtctgtacgttggtttacgggacgtacggggaacctaaggtcgtaaggtaaacttacgtaaacgttacgtaggtcgacgttgacctaactactcgttcgtcttctaacttcccgtaacccg

SEQ ID NO: 336440 - DNA, 589 bp, Homo sapiens
  misc_feature: GZ8MTXP01C861M.45.72.G06.1.454.CMB.2.raw
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
tcagacgcgatcgacacgaccggtgctcgatttagctacgactgcaagggaaaggggggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagacgccaccctctcctgctgggccagtcagagtgttagcaaccacttagcctggtaccagcagaaacctggccaggcctcccagacctcctactatttatggttcttctaccgagggccnctggtacncccagccctaggtcaggtcgccagtggtctgggacngagttcaactctcactatcagcagcctgcagtctagaagtttntttcgatttagttttactttcgtgtacagtactagttactacgtaagttacgtggtcttcgttacgttggttacggaccggtaacggggtactaggtcgtaaagaaacttacgtaaagttcgttggtcgacgttcgacctaactacgttcgttcgttccttactcttcccgtcccg

SEQ ID NO: 336441 - DNA, 570 bp, Homo sapiens
  misc_feature: GZ8MTXP01DFJYH.45.72.G06.1.454.CMB.2.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (422)..(422): a, c, t, g, unknown or other
  misc_feature (422)..(422): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccacctctcctgctgggccagtcagagtgttagcaacacttagcctggtaccagcagaaacctggccaggctcccagactcctcatttangttctctacaggccntgactccagcctagtcagtcgccaggtggtcctggggacagtacgttcaacctctcaaccatcagcagcctgcagtctagaagtattttgacttattttatttctgttcagtntaagtatctaataacgtggtcttagtactaggttttacgcgtaacggggaaccaagccgttaaggaaacttacgaaaacgttaacgttagtcgggcttcggacctaaccctaattccgtttcgttaccttactccgttcccgtccccg

SEQ ID NO: 336442 - DNA, 568 bp, Homo sapiens
  misc_feature: GZ8MTXP01CCQ7M.45.72.G06.1.454.CMB.2.raw
  modified_base (202)..(202): a, c, t, g, unknown or other
  misc_feature (202)..(202): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaangccaccctctcctgctgggccagtcagagtgttagcaaccacttagcctggtaccagcagaacctggccaggctcccagacctcctctatttatggttctctaccgagggtccnctggtactcccagtccaggttcaggtcgccgtaggtcggggtaccctggggacaggtacgttcaacttctcaccatcagcacggcctgcagtctagaattatttgacttagtttattctgtcagtctagtatactattaacgtgtctgtacttagtttacgggaccgtaggggaccaagtcgtaaggaaattacgaaacgacgtagtcggttcgcgaccaactatctagtcttactaacttccttaaccccg

SEQ ID NO: 336443 - DNA, 537 bp, Homo sapiens
  misc_feature: GZ8MTXP01DXOAO.45.72.G06.1.454.CMB.2.raw
  modified_base (467)..(467): a, c, t, g, unknown or other
  misc_feature (467)..(467): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggaatggattggctttgtctattatactggggtcacctaattaccaacccctcctacaagagtccggtcacatttcgtcgaacacgtcacagcctgtcctcctgaaggtgctattctgtcgacccgcgtcgcggactcggccgtgtacttacgtggtcgcgtagaatcgatgagagtgntggttattctaattggttactttgactcgtgggccgngggacgccctggtcnccggtcnccttcgcgtcc

SEQ ID NO: 336444 - DNA, 551 bp, Homo sapiens
  misc_feature: GZ8MTXP01CD8VV.45.72.G06.1.454.CMB.2.raw
  modified_base (384)..(384): a, c, t, g, unknown or other
  misc_feature (384)..(384): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctgtgggtccatgagaagtgactactggagttggatccggcagcccccagggaaggcctggaatggatggctttgtctattatactggggtcaccaattaccaacccctcctacaagacgtccggtcactattcgcgaacacgtccaaacagcctnttctccctgaagtgctattctgtgaccgctcggcgacgtcggccgtgtattacgtggtgcgtagaactcgaatgagtagtgtcgtggttattactaattggttacttttcgacttccgtggggcccgttgggactccgtggtcaccggtcttccttcgaacgtcccg

SEQ ID NO: 336445 - DNA, 604 bp, Homo sapiens
  misc_feature: GZ8MTXP01AG8YZ.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtggtccatgagaagtgactactggagttggatccggcacgcccccagggaacggcctggaatggattggctttgtctattatacgtggggtcaccgtaattaccacccctcctacaagacgtccgggtcactagttcgcgaacacgtccaacagcctagtcctccctgaagtgcattctgtcgaccgctgcggactcggccgtgtacttactgggtgcgtagaagtcgatgagtagtgtctagggttacttctaagttcggtttaactttcggttacgttccgggtcgggggttacccgttacgggggttaccgtccccggttgggttcccgtaacccgggttcccttacccgttccgaacggtttccccg

SEQ ID NO: 336446 - DNA, 698 bp, Homo sapiens
  misc_feature: GZ8MTXP01BOGDH.45.72.G06.1.454.CMB.2.raw
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaagacgccaccctctcctgctgggccagtcagtagtgtagcaactacttagcctggtaccagcaagaacctggccaggcctccagacctcctntatttatggttctctaccgaggtccncgtggtactcccgagtccctaggttcagtcgaccgtaggtcgggtccgtagggacagggtacttccgaacttcctaacaccgactcacgtcacgcctagtctagtctagtaagttagtttcgtacgtttagttttacttcgttgtactagtacgtagttacttacgtaacgttacgttacggttccgttaggttaaccgttacgggtttttacgggaacccgggtaacgggggtaacctaaacggtacggtaaacgggtaaacgttaaaccggtaaaaccggttacggttacggtacggttaccgttcggttaacccgttaaccctaacgttccgttaccggtttccgttaaccgttcccgtttcccgtttaacccccg

SEQ ID NO: 336447 - DNA, 595 bp, Homo sapiens
  misc_feature: GZ8MTXP01DBAY0.45.72.G06.1.454.CMB.2.raw
  modified_base (293)..(293): a, c, t, g, unknown or other
  misc_feature (293)..(293): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagacctcctanatttatggtttcttctaccgacgggtccgctggtactccccgagcccgtaggtcagttcgccgaggtcggggtctggggactaggtacgttccaaccttctcacctatcagtcacgcctgctagtctagaagttatttggacttagttttattctgtcagtctagtactactataacgtgtctgtacgttaggtttcggaccggtaaggggtaccaaggtcgtaaggtaaacttacgtaaaaccgttagtaggtcgacgttggacctaactagtcttcgtccttactaacgttccttccccg

SEQ ID NO: 336448 - DNA, 749 bp, Homo sapiens
  misc_feature: GZ8MTXP01DEF1W.45.72.G06.1.454.CMB.2.raw
  modified_base (218)..(218): a, c, t, g, unknown or other
  misc_feature (218)..(218): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctccagatgggtcctgtcccaggtgcagttgcaggagtcgggcccaggacttgtgaagcccttcgagacgaccctgtaccctnacctgcactgtctctcgtggtccatgagaagtgactacgtggagttggatccggcacggccccccgaaggggaacggccctggaactggtattggctttgtctattatacgtgggtaccaaccgtaactacctacccccttcctacgaacgtacggttcccgggtacaccgtagttttccggaccgaaacctaccggttccaaaacgtcgtccctacggttccctcccgtaggaaacgtcgtctaatttcgacggttcgtacccgcgttcgacggtaccttccgggaccgttaggtttaaacttaccgtggggtttacggaccgttaaacgaagttaccgaagtggtaaggtaaccgttggtaccgtttaggggttaaacctttacggttaaacgtttgggtttttaaaccgtttcggttaaccgtttacccggggttcgggggaccccggttacggggttaacccgttcccccggtaaggggttcccctaaccgggttcccttacccggtccttaaacgggtttcccccg

SEQ ID NO: 336449 - DNA, 808 bp, Homo sapiens
  misc_feature: GZ8MTXP01DFBB5.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgacccctgtcccctcacctgcactgtctctcgtgggtccatgagaagtgactacgtggagttggactccggcacgcccccgagggaacggccgtaggaagtggtagtttggtctttgtcttagttatacgtgggtaccaacctaacttaccaacccccttccctacgaaacggacgtccccgggtccaccgtagtttccggtaccgaaccgtaccgtcccaaacgtaccgtcccgttcggttaccctaccccgtaggtaaacgggttcgtaccgttaacgtttccgttacggttacggtaccccggtcgttccggggtacccgggtaacccgttcccggggttaccccggtttacggtttaacgtttaaccgtttggggggttacggtacgggtaaacggtaaacgttccgggtaaagttgggtaaagggtaaggttcgggttaaccgttttacggggttttaaattttaaccgttaaggttttacgggtttttaaccgtttcggttaacccgggtttcccgggtacgggggttacccgttagggggttacccgtccccggttacggtcccgttaccccgtcgttcccctcgttaacgttccccg

SEQ ID NO: 336450 - DNA, 549 bp, Homo sapiens
  misc_feature: GZ8MTXP01BT4VM.45.72.G06.1.454.CMB.2.raw
  modified_base (390)..(390): a, c, t, g, unknown or other
  misc_feature (390)..(390): n is a, c, g, or t
  modified_base (511)..(511): a, c, t, g, unknown or other
  misc_feature (511)..(511): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagaagtgactactggagttggatccggcacgcccccgagggaaggccgtggaagtggattggctttgtctattagtacgtggggtcaccaattaccaacccctccctacaagacgtccggtcacagtttcggcgaacacgtccaaacncgcctgttcctccctgaacgtgactattctgtcgaccgtctcgcgactcggccgtgtattactggtgcgagactcgagtgagagtgtcgttggttatctaatgttattgactcgtgggcgngggactccgtggcctaccggtcttcctcgaacgtcccg

SEQ ID NO: 336451 - DNA, 730 bp, Homo sapiens
  misc_feature: GZ8MTXP01CASGO.45.72.G06.1.454.CMB.2.raw
  modified_base (203)..(203): a, c, t, g, unknown or other
  misc_feature (203)..(203): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaancgccacctctcctgctgggccagtcagtagtgttagcaacctacttagcctggtaccagcaagaacctggccaggcctcccagacctctctattttagtggtttccttcctaccgtacgggtcccgacttcggtaactccccgagtcccgtagggtttccaggtcgtcccgaggttcggggtcccgtacgggggactaggtaccgtttccaaccgttcctccaaccgtatccgagccacgtccccgtagacctagttacgttaggtaacgtttaagttttcgtaccgtttaggtttttacttttcgttacgttacgtacggtacttaacggttacgttacgttaaacgttaaaccggttcggttacgttacggttaacccgttagggtttttaccgggaccggtaacgggggtaaccgtaacggtaccgtaaagggtaaacttaaccgtaaacggttaaccgttaggtacgttcgttcgacctaaccgtacttcgtcgttcttacctaacgtttcccgttaaccccg

SEQ ID NO: 336452 - DNA, 710 bp, Homo sapiens
  misc_feature: GZ8MTXP01B9YY5.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagaagtgactacgtggagttggactccggcacgccccgaggggaaggccgtggaagtggattggtctttgtctagttatacgtggggtacaaccaattaccaaccccttcccacaacgacgtccgggtccactagttccggtcgaaaccaccgtccaaacacgcccttcgttcctcctagaagtcgctattctgtcgaccgcgtcggcggtacgtcggcccgttagttacgttaccgttggggtcgacggtaagaacgttcgagtaggtagtacggttgtaccgtttaggtttaacgttttaacgttaaacgtttcgggttttaaaccgttttacggttaaccgttacccggggttcggggggttaccccggttaacgggggttaccgggttcccccggttcggggttaaccccgttaaccccggtttcccgttaccccgttccgttaacccgggttttaaccccccg

SEQ ID NO: 336453 - DNA, 604 bp, Homo sapiens
  misc_feature: GZ8MTXP01CGRKU.45.72.G06.1.454.CMB.2.raw
  modified_base (216)..(216): a, c, t, g, unknown or other
  misc_feature (216)..(216): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctnacctgcactgtctctcgtggtccatgagagtgactactggagttggatccggcagcccccgagggaggcctggaatggatggctttgtctattatacgtggggtcaccaattaccaacccctcctcaagcgtcccgggtcacctatttccggtcgaaccacgtcccaacacgccttagttcctcccgtgaacggtgctattctgtcgaccgctgcgtactcggcctgtattacgtggtgcgtagatcgatgagtacgtgtcttaggtttattacgttaagttcggttttacgtttcgaccgttacccgtgggggttcccgagggggttaccgtccccgttcggttcccgtacccggttccttcccgtaaccgttcgggttaacccccg

SEQ ID NO: 336454 - DNA, 781 bp, Homo sapiens
  misc_feature: GZ8MTXP01BI1K7.45.72.G06.1.454.CMB.2.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagacgcgatcgacacgaccggtgctcgatttagctacgactgcaagggaaaggggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagngccaccctctcctgctgggccagtcagagtgttagcaaccacttagcctggtaccagcagaacctggccaggctccagactctcatttatggttctctaccngggccnctggtactccccgagccccgtaggtttccagttcgacccgtaggttcggggtccgttgggggaactagggtaacgtttcccgaaaaccctttcctcccaaaccctacttccgaaacgtccgtaacggccccgtttacgacccgtagttaccgttaacggtaaacggtttaagttttttacggtaccgtttaaggttttttaactttttcgttcggttaccgtaaggtccgtaaaggtttacgttaacttaaacgtttaaacccgttgggtaccgtttacggttaaccgtttaaggggtttttaccgggcccggtaaacggggggtaaacccctaaagggtcccggttaaacggggtaaaacttaccggaaaacggttaaccgttagggttacggttccgttcggacccgtaaccctacgttccgttcggtttaccccgtttacctaaccccgtttccccgtaacccg

SEQ ID NO: 336455 - DNA, 564 bp, Homo sapiens
  misc_feature: GZ8MTXP01C5Q6B.45.72.G06.1.454.CMB.2.raw
  modified_base (216)..(216): a, c, t, g, unknown or other
  misc_feature (216)..(216): n is a, c, g, or t
  modified_base (526)..(526): a, c, t, g, unknown or other
  misc_feature (526)..(526): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctnacctgcactgtctctcgtggtccatgagaagtgactactggagttggatccggcacgcccccagggaacggcctggaatggattggctttgtctattatacgtggggtcacctaattaccaacccctcctacaagacgtccggtcacctagtttccggtcgaaccacgtcccaaacacgccctcgttcctcccgtgaacgtactattctgtcgaccgctgcggacgtcggccgtgtattactgtggcgagtaatcgatgagagtgtctggttatacgtgttgtttacttgtacttcgtcggggcagggcnccgtggacctccggtctcttctaacgttccttaacccg

SEQ ID NO: 336456 - DNA, 678 bp, Homo sapiens
  misc_feature: GZ8MTXP01DI0ER.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagaagtgactacgtggagttggatccggcacgcccccgagggaacggccgtaggaactggtattggtcttttggtcttagttatacgtggggtacaacccgtaaattaccgaacccctcctacgaagtacggttccggtaccacgtatttccggacgaacctacgttccaacgtcttacccttggttcctacccgtagaacggtcgtactatttcgtcgttcgaacccgtcgttcggaccggtaccgttccgggcccgttaggttaacttaccgttaggggtcggtaccgtaaagtaaccgtcggtaagttaggagtaagttcgtacgtttaggttaatttacgtaagtttcggtttaacgtttcgaccgttccgggtgggcccgttagggccgtcccgtgggtcctacccggtcttacccgtcgcgttaaccccg

SEQ ID NO: 336457 - DNA, 579 bp, Homo sapiens
  misc_feature: GZ8MTXP01DUWG0.45.72.G06.1.454.CMB.2.raw
  modified_base (215)..(215): a, c, t, g, unknown or other
  misc_feature (215)..(215): n is a, c, g, or t
  modified_base (456)..(456): a, c, t, g, unknown or other
  misc_feature (456)..(456): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtcccncacctgcactgtctcgtcgtggtccatgagaagtgactacgtggagttggatccggcacggccccgagggaacggcctaggaactggattggtctttggtctatagtacgtgggtacactaataccaccctcctacagcgtccggtcactattcggcaacacgtcaacagtcctcgtctccgtagtaacggtcactatctagtcgaccgtcgtcgccgacgtcgtcgtagttacttacggnggtacgtagtaatacgtacgagtagagtagtgtacgttagttactagttaacgtttaggttacttcgttcgtcggtcgggccgcggccgtccgtcggtcctccgtcttccgtaaccgcgtccg

SEQ ID NO: 336458 - DNA, 696 bp, Homo sapiens
  misc_feature: GZ8MTXP01B0LIS.45.72.G06.1.454.CMB.2.raw
  modified_base (324)..(324): a, c, t, g, unknown or other
  misc_feature (324)..(324): n is a, c, g, or t
tcagacgcgatcgacacgaccggtgctcgatttagctacgactgcaagggaaaggggggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagacgccaccctctcctgctgggccagtcagagtgttagcaacctacttagcctggtaccagcagaaacctggccaggctcccagactcctcatttatcggttctctaccgagggtccnctggtactccccgagtcccgtaggttcaggtcgccgtaggttgggtcctggggacaggtacgttcaaccgttcctcaccgtactcgacggccaggtcctgacgtagttcgtaagaagttagttttcggttaccttagtttttacttttcgtacgttcagtacgtaagttactactaagttaaccgtggtcttaggttacgttacggttttacggaccggtaacgggggtaacctaacggtacgtaaagggtaaaacgttaacccggtaaaacggttaaaccgttgggtacggacccgtttcggaccctaaccccggttaattcccgtttaacggtttccttacctttaaccgtttcccccgtttaacccccg

SEQ ID NO: 336459 - DNA, 587 bp, Homo sapiens
  misc_feature: GZ8MTXP01EIMHM.45.72.G06.1.454.CMB.2.raw
  modified_base (312)..(312): a, c, t, g, unknown or other
  misc_feature (312)..(312): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccaccctctcctgctgggccagtcagagtgttagcaacacttagcctggtaccagcagaaacctggccaggctccagactctcatttatggttctctacagggccnctggtactcccagcccaggttcagtcgccaggtgggtcctggggacagagttcaactctcaccatcagcagcctgcagtctagaagtatttgtctagttttattctgtcagctagtactctaattaactggtcttagtacgttaggttttcgggaccgtaagggggtaacccaaggcgtaagggtaaacttacgaaaacggttaacgttaggtacgggttacttggacctaaccctagtcttcggttcctttactaaccgtttccgtttcccccg

SEQ ID NO: 336460 - DNA, 662 bp, Homo sapiens
  misc_feature: GZ8MTXP01ELVKM.45.72.G06.1.454.CMB.2.raw
  modified_base (445)..(445): a, c, t, g, unknown or other
  misc_feature (445)..(445): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagaagtgactacgtggagttggactccggcacggcccccgagggaacggccgtggaagtggtagttggtctttgtcttattacgtacgtcgggtacaacccgtaacttaccaccccttcctacaacgtacgtccggtacactagtttcgacgaacacgtccaactacgtccttgttcctaccgtagtaacgtcactacttcgngtcgaccgtcgtcgcgacgtcggccgtagttacgttacgtggggtacgacggtaagtaacgtcgaagtggaaggtacgttgtaccgtttagggtttaactttaacgttaagtttcggttttaacttcggttaccgttccgggtacgggttaccgttaggggttacctcccggttacggtcccgtacccggttcttccctaacgaaccgttaaccccg

SEQ ID NO: 336461 - DNA, 567 bp, Homo sapiens
  misc_feature: GZ8MTXP01AMYC7.45.72.G06.1.454.CMB.2.raw
  modified_base (203)..(203): a, c, t, g, unknown or other
  misc_feature (203)..(203): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaanagccaccctctcctgctgggccagtcagagtgtagcaaccacttagcctggtaccagcagaacctggccaggcctccagactcctctatttatgttcttctaccgagggcctctggtactccccgagcctaggttcagtcgccgtaggtcgggtcctggggactagtagttcaactctcacctatcagcacgcctgctagtctagacgtatttgacttagtttatttcgtgtcagtctagtactctagtaacgtggtctagtactaggtttcggacgtaggggacctagcgtaaggaaacttacgtaaacgagtcggtgcgttgacctaactacgtctacgtcttactaacgttcccttccccg

SEQ ID NO: 336462 - DNA, 591 bp, Homo sapiens
  misc_feature: GZ8MTXP01BRDN5.45.72.G06.1.454.CMB.2.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaacctggccaggctccagactcctctatttatggttcttctaccgagggccnctggtactcccagccaggttcagtcgcctaggtgggtcctggggacagtacgttcaactctcacatcagcagcctgcagtctagaagtatttgacttagttttattctgtcagtactagtatactagttaactgggtaccttggtaccgttaggttttacgggaccgtaagggggtaaccaacgggaccgttaagggaaaacttacgaaaacgttacgtagggttacgcgttcgacaaccctatccgttcgtctttactaactttcccgttcccc

SEQ ID NO: 336463 - DNA, 575 bp, Homo sapiens
  misc_feature: GZ8MTXP01EKLJM.45.72.G06.1.454.CMB.2.raw
  modified_base (388)..(388): a, c, t, g, unknown or other
  misc_feature (388)..(388): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagagtgactactggagttggatccggcacgcccccgagggaacggcctaggaatggattggctttgtctattatactggggtcaccgaattaccgaacccctcctacaacgacgtccggtacactagtttcgcgaacacgtccaacncgcctgttctccctgaagtgcgtatctgtgaccgtctggcggactcggcgtgtacttacgtggtgcgacgaatcgatggagtagtgtcttaggttattactaattggtttattcggttaccgtcgttcggggccgttaggggacgtcccgttggtaaccgtcccggtcttccctcgaacgttccccg

SEQ ID NO: 336464 - DNA, 750 bp, Homo sapiens
  misc_feature: GZ8MTXP01EK0VJ.45.72.G06.1.454.CMB.2.raw
  modified_base (303)..(303): a, c, t, g, unknown or other
  misc_feature (303)..(303): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgacctgtccctcacctgcactgtctctcgtggtccatgagagtgactacgtggagttggactccggcacgccccgagggaacggctaggatggattggtntttgtactatttagtacgtcggggtacaacccgtaacttaacccgaaccccttccctaacgaaacggtacgttaccccggggtacctaccgtaacgttttccgggaccgtaaacccgtaaccgttaacccgaaactaccgggtcccctttcgtttacccctaccccgttagggtaaacgggttctacgttacgtttcgtacggttcggtacccggtcgtttacgggacccggtaccggttaccgggtcccggtttaagttaccgtttaacgttcgggggtacggtaaccggtagtaaaccgtcgtaaagtggtaagtaagttggtaccgtttaggtttaacttacgtaagtttacggtttcgtttacgcgtttaccgggtgggaccggttaggggttccgttcccgtggttcccgtacccgtcttaccctaacggttctaaccccgg

SEQ ID NO: 336465 - DNA, 603 bp, Homo sapiens
  misc_feature: GZ8MTXP01D8Q94.45.72.G06.1.454.CMB.2.raw
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggactttgtgaagccttcagacgaccctgtcccctcacctgcactgtctctcgtggtccagtgagaagtgactacgtggagttcggatccggcacggcccccgaggggaaacggcctaggaatggtattggtctttgtcttattatacgtgggtcactaacttaccaccccttcctacagacgtccggtacactagtttcggcaacactcgaacncgtcctgtctcctgaacggtcactnttctgtgaccgtcgtcggcgtaccgtcggtcgtagttaacttcgtgggtcgtagaagtagtcgagttgaggtagtgtactttggttaacttcttaaagttggtttactttggttaccgtcggttcggggcgttacggcgtcccgtacgtccgtcccgtcttcctaacgttaacgttccccg

SEQ ID NO: 336466 - DNA, 675 bp, Homo sapiens
  misc_feature: GZ8MTXP01AHG0P.45.72.G06.1.454.CMB.2.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (636)..(636): a, c, t, g, unknown or other
  misc_feature (636)..(636): n is a, c, g, or t
tcagacgcgatcgacacgaccggtgctcgatttagctacgactgcaagggaaaggggggaactgctcagttaggacccagacggaaccatggaagccccagcgcagcttctcttcctcctgctactctggctcccagaaaccattggagaaatactgatgacgcagtttccagccaccctgtctgtgtctccgaggggaanacgcccaccctctcctgcgtgggccagtcagagtgtagcaaccatagcctggtaccngcagaaccnggccaggcncccagacctcctntatttatgttcttcgaccgngggccnctggtacnccagcctaggttcagtgccgtaggtcggggtcgtacggggacaggtacgtttcccacgttaccctaccaacccgtatcccaaacggccaacgggtccccttagggcctacgttaccgtaaggtaagtttagttttacgtacgtttaaaggtttttccttttacgtcggtacctaggtactagtttactactaattaaccgtggtaccgttaggttaccgttagggtttaccggaccggtacggggtaaccctaaaggtccgtaagggtaaactacgttaaaccggtagttcggttacgcttcgccttaccgtnttcgtaacgttcttaccgttaccttccgttcccgtaacg

SEQ ID NO: 336467 - DNA, 605 bp, Homo sapiens
  misc_feature: GZ8MTXP01BBA78.45.72.G06.1.454.CMB.2.raw
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
  modified_base (567)..(567): a, c, t, g, unknown or other
  misc_feature (567)..(567): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacatgcactgtctctcgtgggtccatgagaagtgactacgtggagttggactccggcacgcccccgagggacggccgtggaatggtattggtctttgtctattatacgtgggtacacctaataccacccctcctcgaagaccgtcggtcaccgtagttcgacgacncgtaccaactacgccttgttcctcccgtagacgtgctattcngtcgaccgctcggccggtacgtcggccgttgtacgttacgtggttcgacgagagtcgagtagagtgtagtcgttaggtttacttaacgttagtttggtttaacgtttggaaccgttcggttacggggttccgacggggtaacncccggttcggtaccctaccgttccctccttcgtaaccg

SEQ ID NO: 336468 - DNA, 594 bp, Homo sapiens
  misc_feature: GZ8MTXP01E4WPM.45.72.G06.1.454.CMB.2.raw
  modified_base (321)..(321): a, c, t, g, unknown or other
  misc_feature (321)..(321): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagacgccaccctctcctgctgggccagtcagagtgttagcaaaccatagcctggtaccagcagaaacctggccaggctcccagactcctctatttatggttccttctaccgaggcccgntcggtactcccgagccctaggttcagtcgcctaggtcgggtcccgtggggactaggtacgtttccaacctctccaacctatcagcacgtcctgacagtctagtaagtatttgacttagttttacttctgtctagctagtactcaagttaactggcttagtacttagggtttcggaccggtacggggaaccaagcgtaaggaaaacttacgaaacgttacgtggtcggcttcgaccaacctattcgtcgtcttaccttaacttcccgttccccg

SEQ ID NO: 336469 - DNA, 717 bp, Homo sapiens
  misc_feature: GZ8MTXP01CWO0K.45.72.G06.1.454.CMB.2.raw
  modified_base (202)..(202): a, c, t, g, unknown or other
  misc_feature (202)..(202): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaanagccacctctcctgctgggccagtcagagtgttagcaaacctacttagcctaggtaccagcagaaacctggccaggctacccagacctcctctatttactcggttcttaccgtaccgagggtcccgtctcggtactccccgagtacccgtaggttcgagttcgcccgtaggttcgggtcccgtaggggacaggtacgtttccaacgttcctaacgtaacccattacccgacgccgagtcccgttagactacggttactaggtaaagttagttttacgtacgtttacgttttatttcgttacgtacgtagtacgtagttacttacgtaagttaaccgtcggttacgtttacgtaacgtttacggggttttacgggaccgtaacgggggtaacctaaacgggtaccgtaaacgggtaaaacttaccggtaaaaccgttaacgttacgggtacgttccgttacgttacctaactacgttcttacggttctttacccgttaacttcccgtttaaccccg

SEQ ID NO: 336470 - DNA, 749 bp, Homo sapiens
  misc_feature: GZ8MTXP01ACRB4.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgccctgtccctcacctgcactgtctctcgtggtccatgagagtgactactggagttggatcccggcacggcccccgagggaacgggcctaggaatggattggctttgtctattatacgtgggtcacctaattaccaacccctcctacaacgacgtcccggtccactagtttccggaccgaaccgtaccgtcccaaacgaccgtccgttacgtttccctcccgttaggtaaacgggttcacgtaactttcgtcggttacgtacccgtcgttcggccggttaaccgtccggggtcccgtttaggttaactttacgtcgggggttacgaccgggtaagtaaacttccggaagttagggaaaggtacggtggttaccgtttagggtttaaactttaccgtttaaggtttacgggtttttaaaccgttttcgggttaaaccccgtttccggggttaccgggggttccgttaaacgggggttacccgtccccggtttacgggtaaccctaccccgggtttccttaccccgttaaccgttccggttaaccccg

SEQ ID NO: 336471 - DNA, 669 bp, Homo sapiens
  misc_feature: GZ8MTXP01E2ZIY.45.72.G06.1.454.CMB.2.raw
  modified_base (161)..(161): a, c, t, g, unknown or other
  misc_feature (161)..(161): n is a, c, g, or t
  modified_base (307)..(307): a, c, t, g, unknown or other
  misc_feature (307)..(307): n is a, c, g, or t
  modified_base (396)..(396): a, c, t, g, unknown or other
  misc_feature (396)..(396): n is a, c, g, or t
  modified_base (543)..(543): a, c, t, g, unknown or other
  misc_feature (543)..(543): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtncagttgcaggagtcggcccaggacttgtgaacgccttcagacgacccctgtcccctcacctgcactgtctctcgtggtccatgagaagtgactacgtggagtggactccggcacgccccgagggacggcgtggaagtggtagtgtntttgtctattatcgtgggtcacctaactaccacccctcctacaaggacgtcccggtacacgtacgttccgacgaacctacgtccaaacncgtcccttgttcctcccgtagtaacgtgctactttccgtgtaccgtacgtccgtgggtaccgtacgtccgggtcccgttgttaaccgtacggtttggggtacggaccggtaagtaaacgtggtaaatggtaacggtagtcgggtttntttacggtttaactttaacgttaaggtttacggtttacgttacggttccgttccgggtcggggccgttacgggttccgtcccggttccgtaacccgtccgtcccttccgtaaccgttccgtccccg

SEQ ID NO: 336472 - DNA, 563 bp, Homo sapiens
  misc_feature: GZ8MTXP01AOZ3J.45.72.G06.1.454.CMB.2.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(535): a, c, t, g, unknown or other
  misc_feature (534)..(535): n is a, c, g, or t
  modified_base (537)..(563): a, c, t, g, unknown or other
  misc_feature (537)..(563): n is a, c, g, or t
tcagacgcgatcgacacgaccggtgctcgatttagctacgactgcaagggaaagggcctggaatggattggctttgtctattatactggggtcaccaattacaacccctccctcaagagtcgggtcaccatttcggtcgacacgtccaacagcctgttctccctgaaggtgcattctgtgaccgctgcggactcggccgtgtattactgtgcgagaatcgatgagagtgctggttattactatggttactttgactccgtggggccagggngccctggtcaccgtcncctcagcttccaccaagggccccatccggtccttccccctggccgcccctgcctccaggacgccacccgtcgtcggggggccacgacggccccgggcccgtggggcctcggacccgttgggtaccaacgggtaccttaaccctttcccgtccggtaacttcccgggtccggttaccgttcggaacgggcccgggggtaccgtcgggggacccgaaaggggcccggacaaacgttagggngngngngnngnnnnnnnnnnnnnnnnnnnnnnnnnnn

SEQ ID NO: 336473 - DNA, 642 bp, Homo sapiens
  misc_feature: GZ8MTXP01BENZQ.45.72.G06.1.454.CMB.2.raw
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (492)..(492): a, c, t, g, unknown or other
  misc_feature (492)..(492): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagtccttcagacgaccctgtccctcacctgctactgtctctcgtgggtccatgagaagtgactacgtggagttggactccggcaccggccccgagggaacggctggaagtggtattgggctttgtcttatagtacgtgggtcaaccgtaacttaccacccctcctacaagcgtccggtctactgttcggcaacacgtcaacacgtctcgttcctcctgaacgtnactatttcgngtcgaccgtcgtacgcggacctcgggtccgtagttaattccgtggggacgtacgagtaaacgtcgngttaggagtacgttcgtaccgtttaggtttaacctttaggttaatttcgggttttaaacttcggttaaccgtccgggttcgggacccggttacgggttacgtccccggtaggttccctcccggttccttccctcgttaaccggttccccg

SEQ ID NO: 336474 - DNA, 731 bp, Homo sapiens
  misc_feature: GZ8MTXP01CU651.45.72.G06.1.454.CMB.2.raw
tcagacgcgatcgacacgaccggtgctcgatttagctacgactgcaaggggaaaggggaggaactgctcagttaggacccagacggaaccatggaagccccagcgcagcttctcttcctcctgctactctggctcccagaaaccattggagaaatactgatgacgcagtttccagccacctgtctgtgtctccgaggggaaagcgccaccctctcctgctcgggccagtcagtgtgtagcaaacctacttagcctggtaccagcaacgaaactcggaccaggcctccacgtacctcctactatttagtcggttcctaccgtaccgacgggtcctacgtcggtactccccgagtcccgtaggtttccaggttccgaccgtagggttcgggtacccgtggggactaggtacgtttccaaaccgttctcccgaaacctgtaccgaacgtcgacggtccctgacctagtaccgtagtaagttacgttttgacgtttagttttattcgtgtacgagtaactagttacttacgtaaagtttaacgtgggtacttggttaaccggttaggtttaaccgggcggtaaacgggggtaaccctaaagggtacccgttaaagggtaaaaacgttaccgaaaaacccgggttggttacggtacgggttaccttcgggaacccgttaaccgtaactttccgttcggtttaccttaccgttaaccgtttccccgtttaaccccgg

SEQ ID NO: 336475 - DNA, 646 bp, Homo sapiens
  misc_feature: GZ8MTXP01C27MG.45.72.G06.1.454.CMB.2.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctggggccagtcagagtgttagcaaccacttagcctggtaccagcagaacctggccaggctccagacctctcatttatggttcttctaccagggtccgctcggtatcccagccctaggtcagtcgcctagtcgggtcctggggactaggacgtttcaaaccgttctcaaccctatacgacgcaacgtccctagccgagtacgtagaaggtattttaggacttagttttatttcttcgtctagtactagttaacgttactaacgttaaacgttaggtacgttacggttaacgttaggtttttacggggaccgtaagggggaaccgtaacgggtaccgtaagggtaaaacgttacgaaaaccggttaacgtacggtaggttacgttcgggacctaacacttcgttcgtacttctaacttccgtttccccg

SEQ ID NO: 336476 - DNA, 700 bp, Homo sapiens
  misc_feature: GZ8MTXP01C6I8X.45.72.G06.1.454.CMB.2.raw
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
tcagacgcgatcgacacgaccggtgctcgatttagctacgactgcaagggaaaggggggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagacgccaccctctcctgctgggccagtcagagtgttagcaaccacttacgcctggtaccagcaacgaaaccgtggccaggcctcccagacctcctctatttatgttctctacgaggccncgtgtacncccgagtccgaggtcagtcgccgtaggtcgggtccgtggggacaggtacgttccaaaccttcctccaaccctactaccacgtccaacgtccctgctagttcgtaggtaagttagttttgactttagttttactttcgttaggtctagtacgtagttaacttcgtaagttaacgttggtacttaggttaacgttagggttttacgggacccggtaacgggggtaaccctaaacgggtaacgttaacgggtaaaaacgttaccggtaaaaaccgttaacggtttacgggtacggttaccgttcggacccgtaaccgttaacgttccgtttcggttacctttacctaaccgtttccccgtttaacccccg

SEQ ID NO: 336477 - DNA, 724 bp, Homo sapiens
  misc_feature: GZ8MTXP01BIS8T.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctcgtcgtggtccagtgagaagtgactacgtgggagttggactccggcacgccccgagggacggctggatgtgttggtctttgtctattacgttacgtcgggtaccaaccctaacttacctaacccctcctacgaagtacggtccggtacctacgttacgttccggtacgtaaccaccgttcccaaactacgtcccgtacgtttccgtacccgtaggtaacggtcgacttacgttcgtagtccggtaccgtcgtcggtaccgggtaccgtccggtaccggttagttacgttacccgtggggtcggtacggtaacgtaacgtacggtaatgggtaagttaggtcgttaccggtttagttaaacgtttactaaggtttcggttttaaaccgttcggttaccggtttccgggtcgggggttacccgttgggggttacccgttaacccggtaccgggttaaccccgaccgggttcccttaccgtcccgttaaccgtccccg

SEQ ID NO: 336478 - DNA, 557 bp, Homo sapiens
  misc_feature: GZ8MTXP02I6QZ6.45.72.G06.1.454.CMB.2.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagacgcgatcgacacgaccggtgctcgatttagctacgactgcaagggaaaggggaggaaatgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctggccagtcagagtgttagcaaccacttagcctggtaccagcaagaacctggccaggcctccagactcctcatttatggtttcttctaccgagggcccnctggtactcccgagccctaggttccagtcgccaggtggtcctgggacagagttcacttctcaccatccagcagcctgcagtctagaagtatttgacttagtttatttctgttacagtcagttatctaataacgtggaccttgtacgtagtttcggaccgtaggggaccaagcgtaggaaactacgaaacgtaactggtcggactgccaacgacttcgtcgtacttcacttccttaccccg

SEQ ID NO: 336479 - DNA, 529 bp, Homo sapiens
  misc_feature: GZ8MTXP02IUWWD.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcagcccccagggaaggcctggaatggattggctttgtctattatactggggtcaccaattacaacccctcctcaagagtccggtcaccatttccggtcgacacgtccaacagcctgttctccctgaaggtgcattctgtgaccgctgcgactcggcctgtattactgtgtcgagaatcgatgagagtgctggttattacgtatggtttacttgacttcgtggggcctagggatcccgtggtccaccgtctcctcgacgtcc

SEQ ID NO: 336480 - DNA, 545 bp, Homo sapiens
  misc_feature: GZ8MTXP02IXISV.45.72.G06.1.454.CMB.2.raw
  modified_base (204)..(204): a, c, t, g, unknown or other
  misc_feature (204)..(204): n is a, c, g, or t
tcagacgcgatcgacacgaccggtgctcgatttagctacgactgcaagggaaaggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaaacctggccaggcctcccagacctcctcatttatggttcttctaccgagggcctctggtactccccgagcccaggttcagtgccaggtgggtcctggggacaggacgttcactctcacatcagcagcctgcagtctagaagtatttgactagtttattctgtcagtcagttatatataactggacttagtactagtttcgcgtagggaccaagtactaggaaatacgaaaacgaacgtgtacggactcgacaacgtatctgtcctactacttctacccg

SEQ ID NO: 336481 - DNA, 517 bp, Homo sapiens
  misc_feature: GZ8MTXP02HAFNQ.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtgggtccatgagaagtgactactggagttggatccggcagcccccaggaggcctggaatggattggctttgtctattatactggggtcacaattacacccctcctcaagatccgggtcaccattcgtcgacacgtccaacagcctgtctccctgaagtgcattctgtgaccgctgcgactcgccgtgtattactgtgcgagaagtcgagttgagagtgcttggttattatagtggttatttcgactcgtgggccgaggcgccgtggtcacgtctctcacgtccc

SEQ ID NO: 336482 - DNA, 530 bp, Homo sapiens
  misc_feature: GZ8MTXP02IC4BH.45.72.G06.1.454.CMB.2.raw
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
tcagacgcgatcgacacgaccggtgctcgatttagctacgactgcaagggaaagggtctctgaagccttcagagaccctgtccctcacctgcactgtctctcgtgggtccatgagaagtgactactggagttggatccggcagcccccagggaagggcctggaatggattggctttgtctattatactggggtcaccaattacaaccctcctcaagagtcgggtcaccatttcggtcgacacgtccaacagcctgttctccctgaaggtgcattctgtgaccgctgcggactcggccgtgtattactgtgcgagaatcgatgagagtgctggttatactatggttacttgactctggggcagggnccctggcacgtctcctcagcttccacaaggcccatcgtctcccctgccncctgctcncgagccnctcgtgggcgacgacgcgccgtcggcgtcgcgtcgtcgaacgacgtacttcctcgtacgtcgcgtcgtcgacggcggcgtcggacgacggacgcgacgtag

SEQ ID NO: 336483 - DNA, 524 bp, Homo sapiens
  misc_feature: GZ8MTXP02JLG2Z.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggaatggattggctttgtctatatactggggtcaccaattacaacccctcctcaagagtccgggtcaccatttcggtcgacacgtccaacagcctgtctccctgaagtgcattctgtgaccgctgcggactcggccgtgtattactgtgcgagatcgatgagagtgctggtatactatggttacttgactccgtggggcctagggagcccgtggtccaccggtctcctcacgtccc

SEQ ID NO: 336484 - DNA, 604 bp, Homo sapiens
  misc_feature: GZ8MTXP02HUCPN.45.72.G06.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
tcagacgcgatcgacacgaccggtgctcgatttagctacgactgcaagggaaagggggaactgctcagttaggacccagacggaaccatggaagccccagcgcagcttctcttcctcctgctactctggctccagaaaccattggagaaatactgatgacgcagtttccagccaccctgtctgtgtctccaggggaaanagccaccctctcctgctgggccagtcagagtgttagcaacacttagcctggtaccagcagaaacctggccaggctccagactcncattangtctntacagggccntgacnccagctagtcagtgcaggtggtcncgggacagtacttcactctacacctatcagctacgcctgcagtctagaattctttgacttagtttttactttcgttagtacgtacgtacgtagtatactaacttaacgtacggtacgttacgttacgttacggtttacggtaccggtaacggggtaaccgtaacgtacgtaaggtaaaacgtaaacgtaaaacgtaaacgtacggtacggtacgtacgtaccacctaacgtacgttacgttactttacctaccgttaccttacccgtaccg

SEQ ID NO: 336485 - DNA, 535 bp, Homo sapiens
  misc_feature: GZ8MTXP02GCXCA.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccagggaaggcctggaatggattggctttgtctattatacgtggggtcaccgtaattaccaacccctcctcaagacgtccggtcaccatttcggtcgacacgtccaacacgcctcgttctcccgtgaacgtgctattctgtggccgctgcgactcggccgtgtatctgtgcgagaatcgatgagagtgctggttattactagtggttacttcgactcgtggggccagggacgccgtcggtctaccgtctccgcacgtccc

SEQ ID NO: 336486 - DNA, 525 bp, Homo sapiens
  misc_feature: GZ8MTXP02I85S0.45.72.G06.1.454.CMB.2.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagagccacctctcctgctgggccagtcagagtgttagcaaccacttagcctggtaccagcagaacctggccaggctccagactcctcatttanggttcttcacgaggccntggtactcccagcccagttcagtcgccagtggtctgggacagngttcactctcaccatcagcagccctgcagtctgaagtatttgactagtttatttctgtcagctagtatctataactggctgtacgtgtttcggcgtagggaccagcgtaggaaactacgaaacgaacgtgtcgactgaccaacacgtctcgtacttctactctttacccg

SEQ ID NO: 336487 - DNA, 620 bp, Homo sapiens
  misc_feature: GZ8MTXP02H0KA2.45.72.G06.1.454.CMB.2.raw
  modified_base (203)..(203): a, c, t, g, unknown or other
  misc_feature (203)..(203): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanacgccaccctctcctgctgggccagtcagagtgttagcaaccacttagcctggtaccagcaagaaacctggccaggcctcccagacctcctcatttatggtttcttctaccgagggccctctggtactccccagccctagggtttccaggtcgacccgtaggttcggggtcccgtaggggacctaggtacgtttcaaccttctccaacccaattccaagccacgcccttgacctagtctagtaagtattttgacttagttttatttctgttcagctaagtatctaattaacgtggtctagtactaggttttggaccgtacggggactaaggtacgttagggaaaacttacgaaaacgtaaacgtggtacggactcggacaaccgtacttacctgttacttctaactttccttccccg

SEQ ID NO: 336488 - DNA, 522 bp, Homo sapiens
  misc_feature: GZ8MTXP02IW8GY.45.72.G06.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctccagactcctcatttanggttcttcaccagggccntggtatcccagcccaggttcagtgccagtgggtcctgggacagagttcactctcaccatcagcagcctgcagtctgaagattttgcagtttatttctgtcagcatatcataactggctgtactagtttggtcgagggaccgaacgacgtacggaatacaaacgaaacgtacgtggctgacaacaactactctcttctactctttcccg

SEQ ID NO: 336489 - DNA, 573 bp, Homo sapiens
  misc_feature: GZ8MTXP02GH0QP.45.72.G06.1.454.CMB.2.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaacctggccaggctcccagacctcctcatttatggtttcttctaccgagggcccntggtactcccagccctaggttcagtgcctaggtggtcctggggacagtacgttcactctcaccatcagcagcctgcagtctagaagtatttgctagttttattctgtcagctagtatctataacgtggtctagtacgttaggtttcggacgtaggggaaccaggctaaggaaaacttacgaaaacgtaacgtggtacggactcggaccaaccgtagttccttcgttacctttactacgtttccctttccccg

SEQ ID NO: 336490 - DNA, 509 bp, Homo sapiens
  misc_feature: GZ8MTXP02HE2RK.45.72.G06.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccacctgtctgtgtctccgaaggggaaagacgccaccctctcctgctgggccagtcagagtgtagcaacatagctgacagcagaacngcagcnccanacnctnattntgtctctacgaggcnctgatactccagcaggtcagtncaggtcggtcngggacagtagtcactctcaacatcagcagcctgcagtctagaagtattttgcttagtttattctgtcagnatatanataatagtcgtagtactagttgtacgacgggacgaacgacgtagaaagtaacaaacgaaacgtacgtacggtacgtacgaacgacactctcgtctactactccg

SEQ ID NO: 336491 - DNA, 557 bp, Homo sapiens
  misc_feature: GZ8MTXP02JSJMY.45.72.G06.1.454.CMB.2.raw
  modified_base (412)..(412): a, c, t, g, unknown or other
  misc_feature (412)..(412): n is a, c, g, or t
  modified_base (452)..(452): a, c, t, g, unknown or other
  misc_feature (452)..(452): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcagcccccagggaaggcctggaatggattggctttgtctattatacgtggggtcaccaattacaacccctcctcaagagtccggtcacctatttcggtcacacgtccaacagcctgtctccctgaagtgctattctgtgaccgntcgcgactcggccgtgtattactgtgcgagatcgatgagngtgcttggttattacgttattagggtttactttcggaccttccggttcgggggaccctaaggggcgtcccgtgggtaccctaccggtcctccctcgacgttcccg

SEQ ID NO: 336492 - DNA, 537 bp, Homo sapiens
  misc_feature: GZ8MTXP02GI7PW.45.72.G06.1.454.CMB.2.raw
  modified_base (510)..(510): a, c, t, g, unknown or other
  misc_feature (510)..(510): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccgagggaaggccgtggaatggattggctttgtctattatactggggtcaccaattaccaacccctcctacaagagtccggtcaccatttcgcgacacgtccaacagcctgttcctccctgaacgtgctattctgtgaccgctgcggactcggccgtgtattactgtgcgagaagtcgatgagagtgctggttattactagttggttactttgacttcgtcggggaccagggacncccgtggctaccgtctcctcacgtccc

SEQ ID NO: 336493 - DNA, 544 bp, Homo sapiens
  misc_feature: GZ8MTXP02FS6XR.45.72.G06.1.454.CMB.2.raw
  modified_base (416)..(416): a, c, t, g, unknown or other
  misc_feature (416)..(416): n is a, c, g, or t
  modified_base (507)..(507): a, c, t, g, unknown or other
  misc_feature (507)..(507): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccgagggaacggcctggaatggattggctttgtctattatactgggtcaccaattaccaacccctcctacaagacgtccggtccacctatttcggtcgaccacgtccaaacacgtcctgttcctccctgaacgtgcattcngtcgaccgctgcgactcggccgtgtattactgtgcgagaatcgatgagagtgcttagtattacgtattgttacttgactcgtcggggaccngggacgcccgtggtcctaccgtcctcctcgacgtccc

SEQ ID NO: 336494 - DNA, 527 bp, Homo sapiens
  misc_feature: GZ8MTXP02FR8KW.45.72.G06.1.454.CMB.2.raw
  modified_base (406)..(406): a, c, t, g, unknown or other
  misc_feature (406)..(406): n is a, c, g, or t
  modified_base (497)..(497): a, c, t, g, unknown or other
  misc_feature (497)..(497): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcagcccccagggaaggcctggaatggattggctttgtctattatactggggtcaccgaattacaaccccctcctcaagagtccgggtcaccatttcggtcacacgtccaacagcctgttctccctgaaggtgcattcngtgaccgctgcgactcggccgtgtattactgtgcgagaatcgatgagagtgctgttatactatggttacttgactcgtggggccagggacncccgtggttcaccggtctcctcgacgtccc

SEQ ID NO: 336495 - DNA, 545 bp, Homo sapiens
  misc_feature: GZ8MTXP02GO3HD.45.72.G06.1.454.CMB.2.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (311)..(311): a, c, t, g, unknown or other
  misc_feature (311)..(311): n is a, c, g, or t
  modified_base (427)..(427): a, c, t, g, unknown or other
  misc_feature (427)..(427): n is a, c, g, or t
  modified_base (526)..(526): a, c, t, g, unknown or other
  misc_feature (526)..(526): n is a, c, g, or t
tcagacgcgatcgacacgaccggtgctcgatttagctacgactgcaagggaaagggggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaacnctagcctggtaccagcaagaacctggccaggctcccagacctcctcatttatggttctctaccagggccntggtactcccagccagggttcagtgccaggtggtctgggacagagttcactctcaccatcagcagcctgcagtctgaagtatttgcttagtttatttctgtactagctaattactntaattaacgtggtacttagtaactaggttttcggaccgtaggggacctaagtcgtaaggtaaactacgaaaacgtacgtagtggctacgcacaattctntactacacttccgtacctc

SEQ ID NO: 336496 - DNA, 545 bp, Homo sapiens
  misc_feature: GZ8MTXP02GOI3G.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccgagggaacggcctggaatggattggctttgtctattatactggggtcaccgaattaccaacccctcctacaagacgtccgggtacacctattcggtcgaccacgtccaacacgcctgttctcctagacgtgctattctgtcgaccgctcgcggtacgtcggccgtgtacttacgtgtcgcgagaactcgatgagagtgctgttatactagtgttacttgacgtcgtcgggtcgaggtacgccgttcgctaccgtctccgtcgacgtcc

SEQ ID NO: 336497 - DNA, 536 bp, Homo sapiens
  misc_feature: GZ8MTXP02JDDR7.45.72.G06.1.454.CMB.2.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgtagcaaccacttagcctggtaccagcagaaacctggccaggctccagacctcctcatttanggttcttcaccagggccnctggtactcccagcccaggttcagtgccaggtggtccgtgggacagtacgttcacttctcaccatcagcagcctgcagtctagaagtatttgtctagtttatttctgtctagtcagtatctatacgtgtactgtactaggtttcgcgaggggaccagcgtagaactacaaacgtaactggtacgctcgacaacgactcgtcgtcttactacttcttcccg

SEQ ID NO: 336498 - DNA, 525 bp, Homo sapiens
  misc_feature: GZ8MTXP02HIME7.45.72.G06.1.454.CMB.2.raw
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggatggattggctttgtctattatactggggtcacctaattaccaacccctcctcaagagtccggtcacctatttcggtcgacacgtccaacagcctgttctccctgaaggtgctattctgtcgaccgctgcggactcggccgtgtattacgtgtgcgagatcgatgagtagtgctggttatactagttgttattcgactcgtgggcngggacnccgtgtcacgtctcctcacgtcc

SEQ ID NO: 336499 - DNA, 620 bp, Homo sapiens
  misc_feature: GZ8MTXP02F0M8S.45.72.G06.1.454.CMB.2.raw
  modified_base (317)..(317): a, c, t, g, unknown or other
  misc_feature (317)..(317): n is a, c, g, or t
  modified_base (411)..(411): a, c, t, g, unknown or other
  misc_feature (411)..(411): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaacctggccaggcctccagactcctcatttatggtttcttctaccgagggccnctggtactccccagccctaggttcagtcgccgaggtgggtcctggggacaggtagttcactctcaccatcagcagcctgctagtctagtaagtnttttgactagttttatttctgtacagtactagttactactaattaacgtggtacttagttacgttagggttttcgggaccggtaacgggggtaaccctaaagggtacgtaagggaaaacttaccggaaaaacggtaacgttgggtacggtactacggacccaaccgtattccgttcgttacctttacgtaaccttcccgtttacccccg

SEQ ID NO: 336500 - DNA, 576 bp, Homo sapiens
  misc_feature: GZ8MTXP02G4J00.45.72.G06.1.454.CMB.2.raw
  modified_base (414)..(414): a, c, t, g, unknown or other
  misc_feature (414)..(414): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccaggaggcctggatggattggctttgtctattatactggggtcaccgtaattaccaacccctccctacaagagtccggtcaccattcgtcgacacgtccaacagcctgttcctcctgaacgtgcattctgtgacccgntgcgactcggccgtgtattactgtgcgagaatcgaatgagtagtgtcttggtattacgttagttcgggtttaactttcggtacttccgtgggggtacccgtaaggggtacgtccccgttagggttcccgtaacccggttctcccgtaccgaacggttccccg

SEQ ID NO: 336501 - DNA, 528 bp, Homo sapiens
  misc_feature: GZ8MTXP02G501U.45.72.G06.1.454.CMB.2.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttagggcccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaaacctggccaggctcccagactcctcatttatggttcttctaccagggccnctggtatccccagcccaggttcagtgccagtggcctggggacagagttcactctcaccatcagcagcctgcagtctgaagtatttgctagtttatttctgtcagcagtatctataactggctgtactagtttggccgtaggggaccaagcgtaggaaaatacgaaaacgtaacgtgtacggctagcaaccatcctgtcttcacttcttcccg

SEQ ID NO: 336502 - DNA, 649 bp, Homo sapiens
  misc_feature: GZ8MTXP02HHASN.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccgagggacggcctggaatggattggctttgtctattatacgtggggtcaaccgtaattaccaacccctcctacaacgagtcccgggtcacctactttcggtcgacacgtccaaacacgtccttcgttcctcccgtagtaaacgggtcgctattctgttcgacccgtctcggccgacgtccggccgttgttaacttactggtgtacgagtagttcgatgagtagtgtacgttaggtttaattacgttaagttcggttttaaactttcggtaccgttccggttcgggggacccgtaacgggggtaccggttccccggttcggggttccccgttaaccccgggttccttccccgttccgtaaccggtttacccccg

SEQ ID NO: 336503 - DNA, 531 bp, Homo sapiens
  misc_feature: GZ8MTXP02FZ5Y0.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggaatggattggctttgtctattatactggggtcaccaattacaacccctcctcaaagagtccgggtcaccatttcggtcgacacgtccaacagcctgttctccctgaagtgcattctgtgaacgctgcggactcggccgtgtattactgtgcgagaatcgatgagagtgctggttatacgtatggttactttgacttcgtggggccagggacgcccgtggtccaccggtctcctcacgtccc

SEQ ID NO: 336504 - DNA, 545 bp, Homo sapiens
  misc_feature: GZ8MTXP02G662F.45.72.G06.1.454.CMB.2.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (320)..(320): a, c, t, g, unknown or other
  misc_feature (320)..(320): n is a, c, g, or t
  modified_base (412)..(412): a, c, t, g, unknown or other
  misc_feature (412)..(412): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaangccaccctctcctgctgggccagtcagagtgttagcaacncttagcctggtaccagcagaacctggccaggcctcccagacctcctcatttatggtttcttctaccgagggccnctggtactccccagccctaggttccagtcgcctaggtggtcctggggacagacgttcacttctcaccatcagcagcctgcagtctagaagtntttgacttagtttattctgtcagtctagtatctatacgtggctagtactagtttgacgtaggggaccaagcgtaaggaaactacgaaacgtataggtacgctcgacaaccgtatctcgtcttcacttcctccg

SEQ ID NO: 336505 - DNA, 528 bp, Homo sapiens
  misc_feature: GZ8MTXP02GB5LQ.45.72.G06.1.454.CMB.2.raw
  modified_base (417)..(417): a, c, t, g, unknown or other
  misc_feature (417)..(417): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggaatggattggctttgtctattatactggggtcaccgaattacaacccctcctcaacgagtccgggtcaccatttcggtcgacacgtccaacagcctgttctccctgaaggtgcattctgtgaccgcngcgactcggccgtgtattactgtgcgagatcgatgagagtgctggttattactatggtttactttgacttcgtggggtccagggcgccgtggcaccggtctcctcagtccc

SEQ ID NO: 336506 - DNA, 615 bp, Homo sapiens
  misc_feature: GZ8MTXP02G9OVK.45.72.G06.1.454.CMB.2.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaanagccaccctctcctgctgggccagtcagagtgttagcaaccacttagcctggtaccagcaagaaacctggccaggcctcccagacctcctctatttatggttctcaccgnggccntggtactcccagcccgtaggttcagtcgaccgtaggtgggtccctaggggaccaggtacgttcacttctcaccatcagtcagcctgctagtcgtagaacgttatttgacttagtttatttcgtgtactagtactagttactactaagttaacgttgggtacttacgttacgttaggtttcggaccggtacggggtaccaaggtcgtaaggaaaactacgaaaacgtacgtaggtacggtacgtacgaccgtaaccgtactaccgttacgttaccttacgtaccgttcccgttaccccg

SEQ ID NO: 336507 - DNA, 519 bp, Homo sapiens
  misc_feature: GZ8MTXP02JAHB5.45.72.G06.1.454.CMB.2.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgctgggccagtcagagtgttagcaaccacttagcctggtaccagcagaaacctggccaggctcccagactcctcatttatggttcttctaccagggccnctggtactcccagcccaggttcagtgccaggtgggtcctggggacagagttcactctcaccatcagcagcctgcagtctgaagtatttgctagtttatttctgtcagtcagtatctataactggtctgtactgtttggcgagggtaccagcgtaggaaatacaaacgactgtcgactgcaacatctacgtcttctactcttcccg

SEQ ID NO: 336508 - DNA, 581 bp, Homo sapiens
  misc_feature: GZ8MTXP02GPVZ1.45.72.G06.1.454.CMB.2.raw
  modified_base (318)..(318): a, c, t, g, unknown or other
  misc_feature (318)..(318): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagacgccaccctctcctgctgggccagtcagagtgttagcaaccacttagcctggtaccagcagaaacctggccaggcctcccagactcctcatttatggttctctaccagggccntggtatccccagcccaggttcagtgccaggtgggtcctggggacagagttcactctcaccatcagcagccctgcagtctagaagtattttgactagtttatttctgtacagtactagttatactataactggtactgtacgtagttttggaccgtaggggaaccgaaagcgtaaggtaaaatacgaaaaccgtaaacgttaggtacggtactcggacctaaccgtaacgttcttacgttcctttactacttccctttaccccg

SEQ ID NO: 336509 - DNA, 570 bp, Homo sapiens
  misc_feature: GZ8MTXP02G4A9T.45.72.G06.1.454.CMB.2.raw
  modified_base (386)..(386): a, c, t, g, unknown or other
  misc_feature (386)..(386): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtggtccatgagaagtgactatggagttggatccggcacgcccccgagggaacggcctggaatggattggctttgtctattatacgtgggtcaccaattaccaacccctcctacaagtagtccggtcacctactttcggtcgacacgtccaacncgtacctcgttcctccctagaacggttcgctattctgtcgaccgctcgcgactcggccgtgtatctgtgcgagatcgatgagtagtgcgttaggttattacttagtcggtttacttcgtacttccggtcggggaccgacggggacgtcccgtggtacccaccggttcctccgtcgtacgttccc

SEQ ID NO: 336510 - DNA, 579 bp, Homo sapiens
  misc_feature: GZ8MTXP02G984K.45.72.G06.1.454.CMB.2.raw
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaccattggagaaatactgatgacgcagtttccagccaccctgtctgtgtctccaggggaaanagccaccctctcctgctgggccagtcagagtgttagcaaccattagcctggtaccagcaagaaacctggccaggctcccagacctcctctatttatggtttctctaccgagggcccnctggtactcccagccctaggttcagtcgccgaggtgggtcctggggacagtagttcactctcaccatcagcagcctgcagtctagaagtatttgcttagtttatttctgtcagtctagtatctaataacgtggacttagtacgtaggtttcggccgtaagggggacctaaggtacgtaaggaaaacttaccgaaaacgtaacgtaggtacggactacgactaaccgtactcttacgttacttactactttcccttccccg

SEQ ID NO: 336511 - DNA, 600 bp, Homo sapiens
  misc_feature: GZ8MTXP02G0QPD.45.72.G06.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaangccacctctcctgctgggccagtcagagtgtagcaacncttagcctggtaccagcaagaacctggccaggcctcccagactcctcatttatcggttctctaccgngggccnctggtactcccagccctaggttccagttcgccgaggttgggtccctggggactaggtacgttccacttctcaccatcgagccaaggtccngctagtctagaagttntttgactttagtttacttcgtagtacacgtacgtattactacgtaagtacgtcggtacttagttacgttaggttacggacgtaacgggactaagtcgtaaacggtaaacacgtaaacgtacgtcggtacgtactacgaccaacgttcgtccgttacgttacctactacctttcccgtaccg

SEQ ID NO: 336512 - DNA, 522 bp, Homo sapiens
  misc_feature: GZ8MTXP02IE78C.45.72.G06.1.454.CMB.2.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgctgggccagtcagagtgttagcaaccacttagcctggtaccagcagaaacctggccaggctcccagactcctcatttanggttcttctaccaggccgctggtatcccagccaggttcagtgccagtggtcctggggacagagttcactctcaccatcagcagcctgcagtctgagtatttgctagtttatttctgtcagcagtatctataactggtctgtactagttttggacgtaggggacaagctaggaaaatacgaaaacgaactagtaggctgacaaccatctcgtcttctactcttccccg

SEQ ID NO: 336513 - DNA, 558 bp, Homo sapiens
  misc_feature: GZ8MTXP02GLUCU.45.72.G06.1.454.CMB.2.raw
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctcccagactcctcatttatggttcttctaccagggccntggtactccccagcccaggttcagtgccagtgggtcctggggacagagttcactctcaccatcagcagcctgcagtctagaatattttgctagttttattcttgtcagtctagtatctataactgggcttagtactaggttttcggccgtagggggaaccaaggacgtaagggaaaattacgaaaacgtaaacgtggtacggactgaccaacctatcgtgtccttctacttccgttaccccg

SEQ ID NO: 336514 - DNA, 593 bp, Homo sapiens
  misc_feature: GZ8MTXP02G73HH.45.72.G06.1.454.CMB.2.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaanagcccaccctctcctgctgggccagtcagagtgtagcaaccacttagcctggtaccagcagaaacctggccaggctcccagacctcctcatttatggtttcttctaccgngggccnctggtactccccgagccctaggttccagtgcctaggttgggtccgtggggacaggtacgttcactctcacctatcagcagcctgcagtctagtaagtagtttgacttagttttactttcgtgtactagtactagttatctaagttaacgtgggtacttagttacttaggttttcggaccggtaacggggtaccgaagtacgtaaggaaaacttacgaaaacgtacgtaggtacgtactgaccaacgtatcctacgtcttcgtacttccgtcccg

SEQ ID NO: 336515 - DNA, 519 bp, Homo sapiens
  misc_feature: GZ8MTXP02HQQCZ.45.72.G06.1.454.CMB.2.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
  modified_base (426)..(426): a, c, t, g, unknown or other
  misc_feature (426)..(426): n is a, c, g, or t
  modified_base (478)..(478): a, c, t, g, unknown or other
  misc_feature (478)..(478): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccacctctcctgctgggccagtcagagtgttagcaaccncttagcctggtacccagcagaaacctggccaggctcccagacctctcatttatggttctctaccaggccnctggtactcccagcctaggttcagtgcctagtggggtcctggggacngacgtttcaccttntccaccatcagcagcctgcagtctgaagtatttgctattttatttctgtcancatctatataactggctgtactagtttgcgaggggacaaagctaggaaactnaaacgaatgtgcgtcgcaaccatctctctctactcttcccg

SEQ ID NO: 336516 - DNA, 565 bp, Homo sapiens
  misc_feature: GZ8MTXP02JZD9L.45.72.G06.1.454.CMB.2.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
  modified_base (366)..(366): a, c, t, g, unknown or other
  misc_feature (366)..(366): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcagaaacctggccaggcctcccagacctcctctatttatggtttcttctaccagggcccntggtactcccagccctaggttcagtgccaggtcggtctggggacngtacgttcactctcaccatcagcagcctgcagtctagaagtatttgcttagttttatttctgtcagtctagtatactattactggtacttgttacgttaggtttacggaccgtaaggggacctaaggacgttaaggaaaactacgaaaaccgtagtcggtagctagctaaccgattcgtcttactctactccttacccg

SEQ ID NO: 336517 - DNA, 617 bp, Homo sapiens
  misc_feature: GZ8MTXP02IEAIY.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcggcccaggacttgtgaagccttcagagacccctgtcccctcacctgcactgtctctcgtggtccagtgagagtgactacgtggagttgatccggcacgccccgagggaaggcctaggaactggtattggtctttgtctagttatacgttggggtacctacctaaagtttaccaacccccttccctacgaacgacggttaccccgggtactacccgtagtttccggtacgtacaaccgtccctaaacacgtcccttcgttaccctccccgtagtaacggtcgtcatttcgtagtcgacccgtcgtcggtccggtaccgtcggtccgtagtacttacgtgtgacgatacgcgagtgagagtgacgtgttatagttacgttgtttacgttcgtacgtcgtcgggacgtaggcgtccgtcgtacctcgtcctccgactacgtcccg

SEQ ID NO: 336518 - DNA, 540 bp, Homo sapiens
  misc_feature: GZ8MTXP02JH08S.45.72.G06.1.454.CMB.2.raw
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtgggtccatgagaagtgactactggagttggatccggcagcccccagggaaggcctggaatggattggctttgtctattatactggggtcaccaattacaacccctcctcaagngtccggtcaccatttcggtcgacacgtccaacagcctgttctccctgaaggtgcattcngtgaccgctcgcggactcggccgtgtacttactgtgcgagaatcgatgagagtgctggttattacgtaattggtttactttgacgttccgtggggcccaggggacgcccgtggtccacccgtctcctcacgtcc

SEQ ID NO: 336519 - DNA, 531 bp, Homo sapiens
  misc_feature: GZ8MTXP02IQY8Q.45.72.G06.1.454.CMB.2.raw
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (505)..(505): a, c, t, g, unknown or other
  misc_feature (505)..(505): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggccccaggacttgtgaagccttcagagaccctgtccctcacctgcactgtctctcgtgggtccatgagaagtgactactggagttggatccggcagcccccagggaaggcctggaatggattggctttgtctattatactggggtcaccaattacaacccctccctcaaagagtccggtcaccatttcggtcgacacgtccaaacancctgttcctcctgaagtgcattcngtggcccnctggcgacgtcggccgtgtattctgtgcgagaatcgatgagagtgcttggtattactattggttactttgactcgtggggccagggacnccgtggtctaccgtctcctcacgtcc

SEQ ID NO: 336520 - DNA, 626 bp, Homo sapiens
  misc_feature: GZ8MTXP02H1B6M.45.72.G06.1.454.CMB.2.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaangccacctctcctgctgggccagtcagagtgtagcaacnttagctgacagcagaactgcagctccngactctnattangttctctaccgnggcctctggtactcccgagccctaggttcaggtcgaccgaggtcggtaccgtggggacctaggacgtttcacgttctcgacctatccgagccagcccttagcgtagtctagtaacgtagtttgtacgttacgtttactttcgtacgttctagtactagtactactagtaacgtgtacgtagttacgtacggttttacggaccggtaacgggtaccgaacggtacgtaacggtaaacgttaaccgtaaaacgtaacggttacggtacggtacgtaccggtactaaccgtacttaccgttacgttaccgttaccgttaccgtttccctttaccccg

SEQ ID NO: 336521 - DNA, 792 bp, Homo sapiens
  misc_feature: GZ8MTXP02GWZ1T.45.72.G06.1.454.CMB.2.raw
  modified_base (200)..(200): a, c, t, g, unknown or other
  misc_feature (200)..(200): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccagggaangccacctctcctgctggccagtcagagtgtagcaaccacttagcctggtaccagcaagaaacctggacccaggcctcccgagacctccctactatttagtcggtttccttcctacccgtaggggccctcgttacggtactccccgaaggtacccgtagggttttccaagggttcgaccccgtaaggggttcggggtaccccgttagggggaacctagggtacggtttcccaacccttccgttaccaacccctaagttcccgaacggtcccaacgggtcccccttaggaccgtacgttaccgttaggtaaaagtttagtttttacggtacctttaaggttttttaacttttccgttaggttacctaaggttacctaagtttaactactaaatttaaaccgtgggtaccttacgttaaccgttagggtttttcgggacccggtaacgggggtaacccgtaaacgggtaccgttaaagggtaaaaccgtaaaccgtaaaaaccggttaaaccgttcgggtacgggtaccttacggaacctaacccgtaacgttcctttacgttacctttacctaacctttccccgtttacccccg

SEQ ID NO: 336522 - DNA, 607 bp, Homo sapiens
  misc_feature: GZ8MTXP02HVX4Z.45.72.G06.1.454.CMB.2.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccagggaaagngccaccctctcctgctgggccagtcagagtgttagcaaccacttagcctggtaccagcagaaacctggccaggctcccagacctcctctatttatcggtttcttctaccgagggccctcgtggtactcccgagccaggttcagtcgccgaggtgggtccctggggactaggtagttcacgttcncaccatcagcacgcctgctagtctagaagtactttgtacttagttttactttcgttgtctagtactaagttattactaattaactggtcttacgttacgttaggttttcggacggtaggggtaaccgtagacgtaagggaaaacttacgaaaacgtacgtaggttcggacgttacggaccgaaccgtacttcgttacgtacttacctactttccctccccg

SEQ ID NO: 336523 - DNA, 548 bp, Homo sapiens
  misc_feature: GZ8MTXP02I6LFK.45.72.G06.1.454.CMB.2.raw
  modified_base (202)..(202): a, c, t, g, unknown or other
  misc_feature (202)..(202): n is a, c, g, or t
tcagacgcgatcgacacgaccggtgctcgatttagctacgactgcaagggaaaggggggaggaactgctcagttaggacccagacggaaccatggaagccccagcgcagcttctcttcctcctgctactctggctcccagaaaccattggagaaatactgatgacgcagtttccagccaccctgtctgtgtctccagggaanagccacctctcctgctgggccagtcagagtgttagcaaccacttagcctggtaccagcagaacctggccaggctcccagacctcctcatttatggttcttcaccgagggccctcgtggtactccccagccctaggttcagtcgccaggtgggtcctggggacagagttcacttctcaccatcagcagcctgcagtctgtaacgtatttgactagtttatttctgtctagtctagttatactataacgtggtctgtacgtagtttcggacgtagggacagtcgtaggaactacgaaacgtacgtgtacgactgacaacgtatcgttacgtcttctacttccttcccg

SEQ ID NO: 336524 - DNA, 541 bp, Homo sapiens
  misc_feature: GZ8MTXP02HNJ56.45.72.G06.1.454.CMB.2.raw
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagccccccgagggaacgggcctggaatggatttggctttgtctattatactggggtcacctaattacaacccctccctcaagacgtccgggtcacctatttcggtcgaccacgtccaacagcctgttcctcctgaagtgcattcngtgaccgntcgcgactcgggccgtgtacttactgtgcgagaatcgatgagagtgcttggttatactagtgtttacttgactcgtgggcctagggagcccgtggtccaccgtctcctcgtacgtccc

SEQ ID NO: 336525 - DNA, 576 bp, Homo sapiens
  misc_feature: GZ8MTXP02JQXYQ.45.72.G06.1.454.CMB.2.raw
  modified_base (202)..(202): a, c, t, g, unknown or other
  misc_feature (202)..(202): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaangccacctctcctgctgggccagtcagagtgttagcaaccattagcctggtaccagcagaacctggccaggcctccagacctcctctatttatggtttccttctaccgagggccntggtactcccgagccctaggttcagtcgccgtaggtggtcccgtggggacaggtacgttcacttctcacctatcagcagcctgcagtctagaatatttgctagtttattctgtcagtctagtatactatagttcggtacttagtacttaggtttcggacgtaggggtaaccaagcttaagggaaaactacgaaaacggtacgttaggtacgtactacgactaaccgtatccgttactctttacctacgttcccttacccg

SEQ ID NO: 336526 - DNA, 571 bp, Homo sapiens
  misc_feature: GZ8MTXP02GVMWR.45.72.G06.1.454.CMB.2.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaangccaccctctcctgctgggccagtcagagtgttagcaaccacttagcctggtaccagcaagaaacctggccaggcctccagacctcctcatttatggtttctttctaccgaggggtcccgctgggtactccccagccctaagggttcaggtgccaggtgggtcctggggacagngttcacttctcacctntccagccagccctgcagtctagaagtattttgcttagttttatttctagttcagtctagttatctaataactggtctgtactagtttcggacgtaggggaccagaccgtaggaaatacgaaaacgtaacgtacgtggtactcgacaaccgtatcctttctcttactacttcctcccg

SEQ ID NO: 336527 - DNA, 524 bp, Homo sapiens
  misc_feature: GZ8MTXP02I6IQV.45.72.G06.1.454.CMB.2.raw
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
tcagacgcgatcgacacgaccggtgctcgatttagctacgactgcaagggaaagggggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaangccaccctctcctgctgggccagtcagagtgttagcaaccacttagcctggtaccagcagaaacctggccaggctcccagactcctcatttanggtttcttcacagggccnctggtatcccagccaggttcagtgccagtgggtcctgggacaggattcactctcaccatcagcagcctgcagtctagaagtatttgctagttttatttctgttcagctagttatactataactggtctagtactagtttcggacgaggggacaagctaggaaatacaaacgaactcgtgactgcaacactctctctctactcttcccg

SEQ ID NO: 336528 - DNA, 531 bp, Homo sapiens
  misc_feature: GZ8MTXP02FMXWO.45.72.G06.1.454.CMB.2.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (440)..(440): a, c, t, g, unknown or other
  misc_feature (440)..(440): n is a, c, g, or t
tcagacgcgatcgacacgaccggtgctcgatttagctacgactgcaagggaaaggggaggaactgctcagttagtacccagacggaaccatggaagccccagcgcagcttctcttcctcctgctactctggctcccagaaaccattggagaaatactgatgacgcagtttccagccaccctgtctgtgtctccaggggaagagccaccctctcctgctgggccagtcagagtgttagcaacacttagcctggtaccagcagaacctggccaggctcccagacctcctnatttanggtttctctaccagggccnctggtactccccagcccaggttcagtgccaggtggtcctggggacaggagttcactctcaccatcagcagcctgcagtctgaagtattttgctagtttatttctgtcagtctagtatcataactggntgtactaggtttcggaccgtagggggacctaagcgtaggaaactacaaaacggaactggtacgctgcaacatctcgtcttcacttctcccg

SEQ ID NO: 336529 - DNA, 689 bp, Homo sapiens
  misc_feature: GZ8MTXP02G6O6V.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtgggtccatgagaagtgactacgtggagttggatccggcacgccccgagggaacggcctggaatggattggctttgtcttattatacgtgggtcacctaacttaccacccctcctacaagtacgtccggtacacctagtttcggcgacaccgtccaacacgtcccttcgttcctcccgtagtaaacgggtcgactattcgtgtcgacccgtcgtcggccggtacgtccgggccgttagttactttacgtcgttacggacgaagtaacgttacggaagttaggaaggtaaggttcggtacgtttaagggtttactttaacgttaaaggtttcggttttaacgtttcggtaaccggttcccgggttacgggggtacccgtaacgggggtacccggttccccggttcgggttaccccggtacccggtttcctacccggttaccgtacggtttacccccg

SEQ ID NO: 336530 - DNA, 656 bp, Homo sapiens
  misc_feature: GZ8MTXP02HK3E9.45.72.G06.1.454.CMB.2.raw
  modified_base (405)..(405): a, c, t, g, unknown or other
  misc_feature (405)..(405): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgcccccagggaggcctggaatggattggctttgtctattatactggggtcacctaataccacccctcctcaacgacgtccgggtcaccatttcggtcgaccacgtccaacagcctcgttcctcctgaaggtcncatttctacggttcgacccgtcgttcggcggtaccgttccgggtacccgttgttaacgttacgtttcggtcggttacggaagaacgttccggaatggtagaaggttcgacgttagggttttaaacttacgttaaagtttcgggttttacgtttacggtaacccgttccggttacgggggtcccggtaggggtaccggtaacccggttcgggtaccctacccgggttcctcccgtcgttaccgtttaccccg

SEQ ID NO: 336531 - DNA, 746 bp, Homo sapiens
  misc_feature: GZ8MTXP02F54A4.45.72.G06.1.454.CMB.2.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgcgtcgggccagtcagagtgttagacaacctacttagcctaggtaccagcaacgaacctggaccaggcctacccagtacctcctactatttacgtggtttcctttacctaccggacgggcccgtcgttggtacctcccgacgtcccgtaggttcaggtcgccgtaggtcggtccgtgggacagtacgttcaccttctcctaccactcacgtaccgacgtcccgtgacctacgttaccgtaggtaaagtttagtttttacgtaccgtttaagtttttaacttttcccgttagttaccgtagtaccgtaaggttaacttaacgtaacgttaaacgttcgggtactttacggttaacgtttacggtttttacgggaacccgggtaacgggggtaaaccgtaaacggtacggtaaacgggtaaaacttaaaccgaaaaaccggttagttacgggttaacgccgttacggaacccaaccgttaacgttccggtttacgtttaccgtttacctaacctttcccgtttaacccccg

SEQ ID NO: 336532 - DNA, 608 bp, Homo sapiens
  misc_feature: GZ8MTXP02JHWM3.45.72.G06.1.454.CMB.2.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
  modified_base (394)..(394): a, c, t, g, unknown or other
  misc_feature (394)..(394): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgtagcaaccattagcctggtaccagcagaacctggccaggctccagactcctcatttatggtttcttcaccngggccnctggtactcccgagcccaggttcagtcgccaggtggtctggacagngttcactctcacatcagcagcctgcagtctagaagtntttgcttagtttactttctgtactagtactagttaatacgtaatacgttacgggtacttagttaaccgtaggttttacgggaccgtaacgggggtacccaaggtaccgttaagggtaaaacgttaccggaaaaacggtaaaccgttggtacgggtaccttacggaccgaaccctgttacctcggttaccttacgttaactcccgtttacccccg

SEQ ID NO: 336533 - DNA, 597 bp, Homo sapiens
  misc_feature: GZ8MTXP02G1X5G.45.72.G06.1.454.CMB.2.raw
  modified_base (321)..(321): a, c, t, g, unknown or other
  misc_feature (321)..(321): n is a, c, g, or t
  modified_base (384)..(384): a, c, t, g, unknown or other
  misc_feature (384)..(384): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccaccctctcctgctgggccagtcagagtgttagcaaccacttagcctggtaccagcaagaaacctggccaggctcccagacctcctcatttatggtttcttctaccgagggcccncgtggtactccccagccctaggttcagtcgcctaggtgggtcctggggacagagttcacttcncactatcagcagcctgcagtctagaacgtatttgcttagtttatttgtcgtcagtctagttatactaataacgttggtacttagttacgtaggttttcggaccgaagggggtaccaaaggtcgtaaggtaaaacgtacgaaaacgtacgttaggtacggtacgtcgaccgaaccgtacttacgttcgttaccttactacttccctttaccccg

SEQ ID NO: 336534 - DNA, 735 bp, Homo sapiens
  misc_feature: GZ8MTXP02G2KP1.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaacgccttcagacgaccctgtcccctcacctgctactgtctctcgtggtccatgagaagtgactacgtggagttggatccggcacgccccgagggacggcctaggatggattggtctttgtcttattatacgtgggtacaaccgtaacttaaccaccccctccctacgaaacgtacggtccccggggtacctaccgttacgtttaccgggtaccgaaccgtacccgttacccaaaccgtacggtaccccgtttcgtttccccgtaccccgttagggtaaaccgggttcgtaccttaacgttttccgtcggttaccggaacccgtcgttcgggacccgggtaaccgttcccggggtaccgttacgtttaactttaccggttggtacggtacggaaggtaacttcggagttaggagtaggtcgtcgtttagggttatttacgttagtttacggtttactttcggacctttccggggtacggggtccgacggggtacctcccggttacggtccctaccggttcctcccgttcgaccggtttaccccg

SEQ ID NO: 336535 - DNA, 584 bp, Homo sapiens
  misc_feature: GZ8MTXP02F7E2C.45.72.G06.1.454.CMB.2.raw
  modified_base (313)..(313): a, c, t, g, unknown or other
  misc_feature (313)..(313): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccaggggaagagccaccctctcctgctgggccagtcagagtgttagcaaccacttagcctggtaccagcagaacctggccaggctcccagactcctcatttatgttcttctaccagggcccntggtactcccagcccaggttcagtgccaggtggtctggggacagagttcactctcaccatcagcagcctgcagtctgaagtattttgctagtttatttctgtacagtctagtactctaattaacgtgggtcttagttactaggttttcggaccgtagggggaaccaaggtacctaagggtaaaactacgtaaaaacggaacgttaggtacgggtacttacggaccaacccgtattaccgttcgttccttacgtacgttccctttacccccg

SEQ ID NO: 336536 - DNA, 575 bp, Homo sapiens
  misc_feature: GZ8MTXP02GQ01M.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggccaggacttgtgaagccttcagagaccctgtccctcacctgcactgtctctcgtggtccatgagaagtgactactggagttggatccggcacgcccccgagggaaggcctggaatggattggctttgtctattatacgtggggtcaccgaattaccaaccccctcctacaaagtacgtccgggtacacctatttcggtcgaccacgtccaacagccttgttcctccctgtaaacggtgctattctgttcgaccgtctgccggtacgtccggccgtgttaattacgtggttcgcgagtaagtcgaagttgagtaggtgtctgggtttattactagtggtttactttgacttcgtcgggccagggacgccgtggtcctaccggtcctcctcacgttccc

SEQ ID NO: 336537 - DNA, 537 bp, Homo sapiens
  misc_feature: GZ8MTXP02F84TH.45.72.G06.1.454.CMB.2.raw
  modified_base (509)..(509): a, c, t, g, unknown or other
  misc_feature (509)..(509): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcagcccccagggaaggcctggaatggattggctttgtctattatactggggtcaccgaattacaacccctcctacaagagtcccgggtcaccatttcggtacgaccacgtccaaacacgcctagtcctccctgaacgtgctattcctgtgaccgtctcgcggactcggccgtgtaacttacctgttcgcgagaactcgatgagagtgctggtatactatggttattcgactcgtcgggccnggacgcctggtcacgtctcctcacgtcc

SEQ ID NO: 336538 - DNA, 630 bp, Homo sapiens
  misc_feature: GZ8MTXP02JK8CL.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgcccccgagggaaggcctggaatggattggctttgtctattatacgtggggtcaccgtaattaccaacccctccctacaaagacgtccgggtcacctattcggtcgacaccgtccaaacacgcctgttcctcccgtgaacggtcgctattctgtgacccgctcggcggtacgtccgggccgttgttaacttacgtgtgcgaagacgtacgatggagtagtcgtacgttagggtttattaacgttagttcggtttacgtttcggtaaccgttccggtcgggggtacccgtaagggggtaccgtccccgttggggtaccccgtacccggttaccctcccgtaccgtacggtttacccccg

SEQ ID NO: 336539 - DNA, 690 bp, Homo sapiens
  misc_feature: GZ8MTXP02I4G0B.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgacccctgtcccctcacctgcactgtctctcgtggtccatgagaagtgactactggagttggatccggacacgcccccaggggaacggcctaggaatggacttggctttgtctattatacgtggggtacacctaaattaccacccctcctacaaagtagtcccgggtacaccgtatttccggtacgaccacgtccaaacacggtccttacgttcctccctaggaaacggttcgacctattcctaggttcgaacccgtcgttcggaccggtactccggggccttaggttaacttacgtggtcgtacgaagtaagttcgattaggagtaacggtgtacgtttagggtttaaactttaacgttacgttagggtttttaaacccttggttaaaccgttccgggtttacggggaaccccgtagggggtaaccctcccggttacggggtaccttaccccgggtccttacccggtttcaaccggtttacccccg

SEQ ID NO: 336540 - DNA, 692 bp, Homo sapiens
  misc_feature: GZ8MTXP02H1ZA8.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtggtccatgagaagtgactactggagttggatccggcacgcccccgagggaacggcctaggaatggtattggtcttttgtctattagtacgtggggtcaccgaacttaccaacccctcctcaagtacgtccggtcacctacgttcggtcgaccacgtccaacagccctgttcctccctgaacgtgctattcgtgtcgacccgtctcggcggtaccgtccgggtccgtggttacttaccgtggttacggtaccgaaggtaaccgtcggtaagttaggaaggtaggttggtaccgtttaggggtttaaactttaacgttaagtttacgggtttttaaacgttttcggttaacccgtttccgggttacgggggtacccggaaacgggggttaccggtcccccggttacggggtccccttaccccgggttccctttaccccgttccgtaccggtttacccccg

SEQ ID NO: 336541 - DNA, 543 bp, Homo sapiens
  misc_feature: GZ8MTXP02F6P74.45.72.G06.1.454.CMB.2.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (393)..(393): a, c, t, g, unknown or other
  misc_feature (393)..(393): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaccattggagaaatactgatgacgcagtttccagccaccctgtctgtgtctccaggggaaanagccaccctctcctgctgggccagtcagagtgttagcaaccacttagcctggtaccagcagaaacctggccaggctccagactcctcatttatggttcttctaccgagggccnctggtactccccgagccctaggttcagtgccaggtggtcctggggacagagttcactctcaccatcagcagcctgacngtctagaagtattttgacttagttttatttctgtcagtctagtatctaatactgggtctgtacgtagtttcggacgtagggacagtcgtaggaaactacaaacgtaactgtacggctagaccaactatctacgtctactactccttcccg

SEQ ID NO: 336542 - DNA, 617 bp, Homo sapiens
  misc_feature: GZ8MTXP02I3IE3.45.72.G06.1.454.CMB.2.raw
  modified_base (412)..(412): a, c, t, g, unknown or other
  misc_feature (412)..(412): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccagggaaggcctggaatggattggctttgtctattatacgtggggtcacctaacttaccacccctcctcaagtacgtccggtcacctatttcggtcgacacgtccaacacgccttgttcctcccgtagtaacggtncgtattcgtgtcgaccgctcggccggtacgtccggtccgttgtactttaccgtggtcggtacgacgtaagtacggagttaggagtaggtgtcgtttagggtttaacttacgttagttacggttttacgtttacgtaccgttccggttcggggaccgtaggggaccgtcccgtaggtcccgtaccggtccctcctcgacgtccccg

SEQ ID NO: 336543 - DNA, 525 bp, Homo sapiens
  misc_feature: GZ8MTXP02H4H4S.45.72.G06.1.454.CMB.2.raw
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (388)..(388): a, c, t, g, unknown or other
  misc_feature (388)..(388): n is a, c, g, or t
  modified_base (452)..(452): a, c, t, g, unknown or other
  misc_feature (452)..(452): n is a, c, g, or t
  modified_base (495)..(495): a, c, t, g, unknown or other
  misc_feature (495)..(495): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggccccaggacttgtgaagccttcagagaccctgtccctcacctgcactgtctctcgtgggtccatgagaagtgactactggagttggatccggcagcccccagggaaggcctggaatggattggctttgctattanactgggtcaccaattacaacccctcctcaagngtccggtcaccattcggtcacacgtccaacagcctgtctcccngaagtgcattctgtgaccgctcgcggactcggccgtgtattactgtgcgagaatcgatgagagngctggtattactatggttactttgactctcggggccaggggcncccgtggtccaccggtctccgtcacgtccc

SEQ ID NO: 336544 - DNA, 598 bp, Homo sapiens
  misc_feature: GZ8MTXP02JCGSL.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgcccccgagggaacggcctaggaactggagtttggtctttgtctattatacgtggggtcacctaattaccaacccctcctacaagtacgtccggtcacctatttcggcgacacgtccaacacgccttcgttcctccgtagaacggtcgctattcgtgttcgaccgcgtcgcggtacgtcggccgtgttacttacgtgtgcgagtacgtacgtagtggagtagtgcgtttagttacttacgttagtttcggtttactttcgtaacgttccggtcggggaccgtagggaccgtccgtacggtcctaccggtctcctcgacgttacccg

SEQ ID NO: 336545 - DNA, 577 bp, Homo sapiens
  misc_feature: GZ8MTXP02I6LEQ.45.72.G06.1.454.CMB.2.raw
  modified_base (316)..(316): a, c, t, g, unknown or other
  misc_feature (316)..(316): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagacgcgatcgacacgaccggtgctcgatttagctacgactgcaagggaaagggggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggcctcccagacctcctcatttatggttcttctaccagggcccnctggtactcccagcctaggttcagtgccaggtcgggtctggggacaggagttcacttctcaccatcagcagccctgctagtctagaagtntttgcttagttttntttctgttacagtctagttatctaagttactgggtcttagtaccgtaggtttcggaccgtagggtaccaagtcgtaggaaaactacgaaaacgtacgtaggtacggtctacgcctaacctaagttccgtcgttcttactacttcccttaccccgtac

SEQ ID NO: 336546 - DNA, 563 bp, Homo sapiens
  misc_feature: GZ8MTXP02HG3FV.45.72.G06.1.454.CMB.2.raw
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtcccctnacctgcactgtctctgtgggtccatgagaagtgactatggagtggatccggnagccccaggaaggctgaatgatggctttgntatanactggggtcacaaattacaaacccctccacaaagagtaccggtcaaccatttcggcaacacgtccaaaacncgcctgtcctccagagtnactattcgtgtcgaccgtctcgcgacgtcgtcgtagtagttagtgtgagagaagtacgagtagagtagtagtacgtagttaagttaacgttacgttagttacttacgtacgtccgtacgggaccggacggacgtccgtcgtaccgtaccgtaccgtcctacctacgtaccg

SEQ ID NO: 336547 - DNA, 625 bp, Homo sapiens
  misc_feature: GZ8MTXP02F067H.45.72.G06.1.454.CMB.2.raw
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaccattggagaaatactgatgacgcagtttccagccaccctgtctgtgtctccgaggggaagacgccaccctctcctgctgggccagtcagagtgttagcaaccattagcctaggtaacagcaagaacctggccaggcctccagactcctntatttatggttccttctaccgngggccntggtactcccagcccaggttcaggtcgccgtaggtggtcccgtggggacaggtacgttcacttctccaccatcagccagcctgcctagtctagtaagttattttgacttagtttttactttcgtgtacacgtactaagttactacgtaattaaccgttggtacttacgttaacgttacgggtttacggaccggaacgggggtacctaacggtacgtaaacggaaaacttacgaaaaccggtaagtcggtacgtacgtacgtacctaaccgtacttcgtacttccttacctactttccccttaccccg

SEQ ID NO: 336548 - DNA, 534 bp, Homo sapiens
  misc_feature: GZ8MTXP02FGTCI.45.72.G06.1.454.CMB.2.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
tcagacgcgatcgacacgaccggtgctcgatttagctacgactgcaaggggaaaggggggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagttgttagcaaccacttagcctggtaccagcagaaacctggccaggctcccagactcctcatttatggttcttctaccaggggcccnctggtactccccagccagggttcagtcgccaggtggggtctggggacagagttcactctcaccatcagcagcctgctagtctagaagtattttgcttagttatttctgtcagctagtatcataacgtggctgtactagtttggcgtaggggaccagctaggaaactacgaaacgaacgtgtaggctcgcaccaagtctcgtcttcactcctccgcc

SEQ ID NO: 336549 - DNA, 529 bp, Homo sapiens
  misc_feature: GZ8MTXP02F8VNZ.45.72.G06.1.454.CMB.2.raw
  modified_base (312)..(312): a, c, t, g, unknown or other
  misc_feature (312)..(312): n is a, c, g, or t
  modified_base (432)..(432): a, c, t, g, unknown or other
  misc_feature (432)..(432): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcagcccccgagggaaggcctggaatggattggctttgtctattntactggggtcacaattacaacccctcctcaagagtccggtcaccatttcgtcgacactccaacagcctgtctccctgaagtgcattctgtcgaccgctgcggactcggccgtgtattacngtgcgagaatcgatgagagtgctggttatactatggtttactttgacttcgtcgggtccagggacgcccgtcggtcacccggtcctcctcacgtccc

SEQ ID NO: 336550 - DNA, 623 bp, Homo sapiens
  misc_feature: GZ8MTXP02G1TBS.45.72.G06.1.454.CMB.2.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaacctacttagcctggtaccagcagaaacctggaccaggctcccagacctcctctatttatggtttctttctaccgaggggccctgtggtactccccgagcccgtaggttccagtcgccgtaggtcgggtccctaggggacaggacgttcaccttcncaccntcagcacgcctgcagtcagtaagttatttgacttagttttattctgttactagtctagtatactaattacgtggtctagttacgtggtttacggacgtaacggggacctaaggtacgtaacggtaaaacgttaaccgaaaaccggttaacgtaggtacggtacctacggacctaacgtacttaccgttcgttaccgttactaccgtttacccctttccccg

SEQ ID NO: 336551 - DNA, 542 bp, Homo sapiens
  misc_feature: GZ8MTXP02JNI3Z.45.72.G06.1.454.CMB.2.raw
  modified_base (414)..(414): a, c, t, g, unknown or other
  misc_feature (414)..(414): n is a, c, g, or t
  modified_base (511)..(511): a, c, t, g, unknown or other
  misc_feature (511)..(511): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccagggaaagagccaccctctcctgctgggccagtcagagtgttagcaaccacttagcctggtaccagcagaactggaccaggcctcccagctcctcatttatggtttcttctaccgagggccgtctggtactccccgagtcccgaggttcagtcgccaggtgggtccctggggacagtacgttcactctcaccgtatcagcacgcctgcagtctagaagtntttgctagtttatttctgtctagtacagtatcataactggctgtacgtagtttcggacgtagggaccagcgtagaatacgaaacgactagtcgtcgngcaacgtactacgtcgtctactctcttcccg

SEQ ID NO: 336552 - DNA, 551 bp, Homo sapiens
  misc_feature: GZ8MTXP02FICWZ.45.72.G06.1.454.CMB.2.raw
  modified_base (373)..(373): a, c, t, g, unknown or other
  misc_feature (373)..(373): n is a, c, g, or t
  modified_base (516)..(516): a, c, t, g, unknown or other
  misc_feature (516)..(516): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacatgcactgtctctcgtgggtccatgagaagtgactactggagttggatccggcaggcccccagggaacggcctggaatggattggctttgtcttattatacgtggggtcaccaattacaacccctcctacaagacgtcggtcacatttcggcacncgtccaaacagcctgttctccctgaacgtacatttctgtgacccgtctggccgtacgtcggcccgtgttacttacgtgtgcgaagaagtcgagtgagagtgcgttgtttatactattgtttattcgactccgtcggggtccgngggacgcccgtgtccgaccgtctcctcgacgtccc

SEQ ID NO: 336553 - DNA, 551 bp, Homo sapiens
  misc_feature: GZ8MTXP02HTNAV.45.72.G06.1.454.CMB.2.raw
  modified_base (316)..(316): a, c, t, g, unknown or other
  misc_feature (316)..(316): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
tcagacgcgatcgacacgaccggtgctcgatttagctacgactgcaagggaaagggggaactgctcagttaggacccagacggaaccatggaagccccagcgcagcttctcttcctcctgctactctggctcccagaaaccattggagaaatactgatgacgcagtttccagccaccctgtctgtgtctccaggggaaagagccaccctctcctgctgggccagtcagagtgttagcaaccacttagcctggtaccagcagaaacctggccaggctccagacctcctcatttatggttcttctacccgaggggccnctggtactcccagccagggttcagtgcctaggtgggtctcggggacaggtagttcactctcnccatcagcagccctgcagtctgaagtntttgcttagtttatttctgttcagtcagttatcaattactggtactgtactagtttcggaccgaggggtaccagtcgtaggaaactacgaaaacgactaggtcggactgaccacctaatctcgttcttccacttccttaccccgac

SEQ ID NO: 336554 - DNA, 581 bp, Homo sapiens
  misc_feature: GZ8MTXP02JUW9R.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagagtgactactggagttggatccggcacgcccccgaggggaacggcctggaatggattggctttgtctattatacgtgggtcactaattaccacccctcctcaagagtccggtcactactttcggtcacacgtccaacacgcctgtctccctagaaggtcgctattcgtgtcgaccgctcgcggactcggccgtgtacttacgtgtgcgagtatcgatgagtagtgcgttaggttatacttagttcggtttaactttcgaccgttccggttcggggaccgtaggggtaccgtcccgtcgggtcctacccggtccttacccgttcgaccggtttccccg

SEQ ID NO: 336555 - DNA, 537 bp, Homo sapiens
  misc_feature: GZ8MTXP02FIQTY.45.72.G06.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaaccacttagcctggtaccagcagaaacctggccaggctccagactcctnatttatggtttcttctaccaggggccnctggtactccccagcccaggttcagtgccaggtgggtcctggggcagagttcactctcaccatcagcagcctgcagtctgaagtatttgctagttttatttctgttcagctagtatctaataactggtctgtactagtttggcgtaggggaccaagcgtaggaaactacgaaacgtaactgtcgtactgacaaccatcctgtctactactcttaccccg

SEQ ID NO: 336556 - DNA, 658 bp, Homo sapiens
  misc_feature: GZ8MTXP02JXC20.45.72.G06.1.454.CMB.2.raw
  modified_base (207)..(207): a, c, t, g, unknown or other
  misc_feature (207)..(207): n is a, c, g, or t
  modified_base (323)..(323): a, c, t, g, unknown or other
  misc_feature (323)..(323): n is a, c, g, or t
tcagacgcgatcgacacgaccggtgctcgatttagctacgactgcaagggaaaggggggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaangccaccctctcctgctgggccagtcagagtgtagcaacctattagcctggtaccagcaagaacctggccaggcctacccagacctcctcatttatggtttcttctaccgcgggccntggtactcccagcctaggttcagtcgccgaggtcgggtcctggggacaggtagttccacttctcacctatccgagcacgcctggactagtctagtaaagttctttgacttagttttatttccgtagtcctagtctaagttactactaattaaccgtgggtactacgtttaaccgttaggttttaccgggaccggtaacgggggtaacccgtaaaagggtcgttaaacggggtaaaacttaccggaaaaccgtaaacggtgggttacggaccttacggaccgaaccttaacggttccttacggttccttaacccgtttaccgtcccttacccccgg

SEQ ID NO: 336557 - DNA, 581 bp, Homo sapiens
  misc_feature: GZ8MTXP02HVV4D.45.72.G06.1.454.CMB.2.raw
  modified_base (489)..(489): a, c, t, g, unknown or other
  misc_feature (489)..(489): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtcccctcacctgcactgtctctcgtggtccatgagaagtgactactggagttggatccggcacgcccccgagggaacggcctggaatggattggctttgtctattatacgttggggtcacaattaccaacccctcctacaagacgtcccgggtacacctattcggtcacacgtccaacagcctcgttctccctgaacgtgctattcctgtcgaccgtctcggcggtcgtccgggcctggtatttaccgtgttcggacgagtaaatccgaagtgaggtagngtgtaggtttattacttagttggtttactttcgacgttccgtcggggcctaaggggctccgtcggtactaccgtctcccgtcgacgttcccg

SEQ ID NO: 336558 - DNA, 619 bp, Homo sapiens
  misc_feature: GZ8MTXP02FZDO3.45.72.G06.1.454.CMB.2.raw
  modified_base (240)..(240): a, c, t, g, unknown or other
  misc_feature (240)..(240): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccntgagaagtgactacgtggagttggatccggcacgcccccgagggaacggccgtggaatggattggcgtttgtctagttagtacgtggggtcaacctaaacttacctaaccccctcctacaagtcgtccggtacacctagtttcgcactacgtccaactagtcctcgttcctccctagagtcgactattctgtcaccgctcgcgtacgtcgccgtgttacttacgtgtcgacgagaagtcgaatggagtagtgtcgttaggttaattcgttagttcggtttaaacgtttcggtaccgtttccggtcggggtaccgtacggggtaccgtcccggttacgggtcctaaccccggttccttcccgtaccgtaacgttcccccg

SEQ ID NO: 336559 - DNA, 571 bp, Homo sapiens
  misc_feature: GZ8MTXP02IXUDM.45.72.G06.1.454.CMB.2.raw
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacatgcactgtctctcgtggtccatgagagtgactactggagttggatcggcacgcccccgagggaacggcctggaatggatggtctttgtctattagtacgtgggtacactaattacccaaccctcctacaagacgtcggtcacctatttcgtcgacncgtccaacacgccctgttctccctagtaaacgtactattcctgtcgacccgtntcggcgtacgtcggccgtnttacttactgtgcgtagagtcgatgagtagtgtcttaggtattactagttggtttactttgaccttccggtacggggccaggggtacgtccgtcggttcacccggttctcccctgtacggttccc

SEQ ID NO: 336560 - DNA, 527 bp, Homo sapiens
  misc_feature: GZ8MTXP02I7G03.45.72.G06.1.454.CMB.2.raw
  modified_base (393)..(393): a, c, t, g, unknown or other
  misc_feature (393)..(393): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcagcccccagggaaggcctggaactggattggctttgtctattatactggggtcaccaattacaacccctcctcaagacgtccgggtcaccattcggtcgacacgtccaacagcctgttctccngagtgctattctgtcgaccgctcgcggactcgggccgtgtattactgtcgtcgagaatcgatggagagtgctggtatctagtgttacttgacttcgtagggccaggacgcctggactccgtctcctcgactccg

SEQ ID NO: 336561 - DNA, 620 bp, Homo sapiens
  misc_feature: GZ8MTXP02INZ3X.45.72.G06.1.454.CMB.2.raw
  modified_base (284)..(284): a, c, t, g, unknown or other
  misc_feature (284)..(284): n is a, c, g, or t
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (473)..(473): a, c, t, g, unknown or other
  misc_feature (473)..(473): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtcatgagaagtgactacgtggagttgatccggcacgcccgaggacggcnggatggatgctttgtctattatacgtgggtacaccaattaccaacccctcctcaaagtcgtcggacactattcgcacactccaancgtccttgttccctcgtagtaagtgcactttngttcaccgtcnggaccgtacgtccggccgtagttacttacgtgtacgacgagtaactcgattagagtgtgtntttaggttaacttacgtttagttacggttttacctttacggtaaccgttccggggttcgggggaaacccggtaggggtaacccggttcccggtaacgggtttcccgtaaccccggtttacttccccgtacgtaaacgggtttccccc

SEQ ID NO: 336562 - DNA, 608 bp, Homo sapiens
  misc_feature: GZ8MTXP02J13DD.45.72.G06.1.454.CMB.2.raw
  modified_base (529)..(529): a, c, t, g, unknown or other
  misc_feature (529)..(529): n is a, c, g, or t
  modified_base (596)..(596): a, c, t, g, unknown or other
  misc_feature (596)..(596): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtcccctcacctgcactgtctctcgtggtccatgagaagtgactactggagttggatccggcacgcccccgagggacggcctaggaatggattggctttgtctattatacgtgggtacaccgtaaacttaccaaccccctcctacgaacgtacgtcccggggtacaccgtagtttccggcgaaccacgtcccaaacacgtcccttcgttccctcccgtaggaaacggtcgtcctaagtttcccgtagttcgacccgtcgttcggccggtacgtcgggtccgttagtacgtttactggtagcgaagtaagtcgatggaagngtgcgttagttactattgtaggttacttcgtactcgtgggccgtaggacgtccgtggtccacgttcncctcacgtcccg

SEQ ID NO: 336563 - DNA, 721 bp, Homo sapiens
  misc_feature: GZ8MTXP02F3IOY.45.72.G06.1.454.CMB.2.raw
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagcccaccctctcctgctgggccagtcagagtgttagcaaccacttagcctggtaccagcaagaacctggccaggcctcccagacctcctntatttatggttctctaccgagggcccnctggtactccccgagtcccgtaaggttcaggtcgacctagggttcggggtaccctggggacctagggtacgtttccaaccttctaccaaccctaagttccaacggtccaacggcccgttagaccgtacgttccgtaaggtaaacgtttacgtttttaggtactttaggtttttaacgttttaccttgggttacctaggtacctaaaggttattaccgtaagtttaaccgttgggtaccgtttacggtaagttacgggtttttacgggaaccggttacgggggaaacctaagggtacgtaaacgggtaaaactaaccggtaaaacgtaaaccgtacggttcgggtactacggtaaccaacgtcgttacctcggttactttactaccttccctttaccccg

SEQ ID NO: 336564 - DNA, 646 bp, Homo sapiens
  misc_feature: GZ8MTXP02IJOQ7.45.72.G06.1.454.CMB.2.raw
  modified_base (448)..(448): a, c, t, g, unknown or other
  misc_feature (448)..(448): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcgagagacccctgtcccctcacctgccactgtctctcgtggtccatgagagtgactacgtgagttgatccggcacgccccgagggacggccgtaggaatggagttggtctttgtctattagtacgtagggtactaaccgtaacttaccaacccctcctacgaaagtacgtccggtacacctacgtttcggtcgtaacgaccgtccgaactacgtcccgttacgttcctccgtaggtacgtcgctattcgngtcgacgtcgtcggcgtacgtccggaccgtagttacgttacgtgtcggtacgtagtacgtacgtagtagtacgtagttcgtcgttagggtttactttacgttacgtttcggtttactttcggtaccgttaccggtcggggtacccgtagggtaccgtcccgtcggtacctacccgtccgtaccgtacgacgttacccg

SEQ ID NO: 336565 - DNA, 616 bp, Homo sapiens
  misc_feature: GZ8MTXP02GJQXV.45.72.G06.1.454.CMB.2.raw
  modified_base (290)..(290): a, c, t, g, unknown or other
  misc_feature (290)..(290): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagaagtgactacgtggagttggatccggcacgccccgagggacggccnggaatggattggctttgtctattatacgtgggtcacctaattaccacccctccacaagtcgtccggtacacctatttcggacacacgtccaacacgtccttcgtacctccgtagacgtcgactattcgtgcgaccgtcgtcgcggtacgtccggtacgttagttattaccgttgtacggacgtagaacgttgaagtggagtagtgtcgttaggtttaattacgttatttaggtttactttcggtaccgttccgggtcggggtaccggacgggtaccgtcccgttcggtacccgtacccggtccttacccgtacgtacgttaccccg

SEQ ID NO: 336566 - DNA, 622 bp, Homo sapiens
  misc_feature: GZ8MTXP02IC9F0.45.72.G06.1.454.CMB.2.raw
  modified_base (274)..(274): a, c, t, g, unknown or other
  misc_feature (274)..(274): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (494)..(494): a, c, t, g, unknown or other
  misc_feature (494)..(494): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtgggtccagtgagaagtgactacgtggtagttgatccggcncgccccgaggaacggccgtaggaatggattggtcgtttgtacttattagtacgtggggtaccaccgtaaactttaacccaaccccctccctacgaagtacgtcccgggtacaccgtacgttcggtacacgacgtccaaacgngtccctgttcctccgtagaacgtcgantttctcggtcgaccgtgtcgcggtacttcggccgttgtaacttgtgtacgngagtatcgatgacgtgtgtcgttagtattaacgttagtagttttacgttctaccgttcggtacgggacccgttaggggaccgtcccggtttcggtacctacccgtcgtttcccctacgtaccgtcccg

SEQ ID NO: 336567 - DNA, 606 bp, Homo sapiens
  misc_feature: GZ8MTXP02GGWQ4.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccgaggggaacggcctaggaagtggacgtttggtcttttgtcttattatacgttggggtccaacccgtaaattaccaaccccctcctacaaggtagtcccggtccacctagtttccggtacgacacgtccaacacgccttgttcctcctgaacggtcgctattctagtcgacgcgtcgcgtacgtcggccgtgttacttacgtgtgacgagactcgatgagtgtagtcgttaggttattactagttacgtttacttcgtaaccgttcggttcggggaccgtacgggacgtcccgtcggtacctacccggtctacccgtacgacgttacccg

SEQ ID NO: 336568 - DNA, 720 bp, Homo sapiens
  misc_feature: GZ8MTXP02HDCA6.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagagtgactacgtggagttggatccggcacgccccgagggacggccgtggaagtggagttggtctttgtcttattagtacgtgggtacaaccgtaacttaccacccctcctacgaagacgtccggtcacctacttcggtcgacacgtccaacacgtcctacgttcctaccctaggtaaacggtcgactactttcgtcggtacgacccgtcttcggaccggtaccgtccgggtacccgttgttaacgtttacgttcggtacggttaccggaagtaacgttaccgagttaggaaggttaaggttggttaccgttagggttttaaactttacggtttaagtttacgggttttaacctttacggttaacccgttcccggggttacgggggtacccgtaaacgggggtaccgttccccgggttacgggttaccccgtaacccccgggtttcctttcccccgtacgtaaccccgtttcccccgg

SEQ ID NO: 336569 - DNA, 594 bp, Homo sapiens
  misc_feature: GZ8MTXP02I8T2C.45.72.G06.1.454.CMB.2.raw
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (467)..(467): a, c, t, g, unknown or other
  misc_feature (467)..(467): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtgggtccatgagaagtgactactggagttggatccggcacgcccccgagggaacggccgtggaagtggagtttggtctttgtactattagtacgtggggtacaccgtaaattaaccaaccccctcctcaaagcgtccggtcacctattcgtcgacacgtccaacncncctgtcctccctgaaggtgcattcgtgtcgacccgtctcgccggacgtcggccgtgttacttactgngtcgagaatcgatcggagagtgtacgttaggttattacttagttcggtttactttcgtaaccgttcgtcgggggtacctacggggtacgtcccgttcggtcccgtaccgtcgtaccctcgactcccg

SEQ ID NO: 336570 - DNA, 579 bp, Homo sapiens
  misc_feature: GZ8MTXP02GSP08.45.72.G06.1.454.CMB.2.raw
  modified_base (323)..(323): a, c, t, g, unknown or other
  misc_feature (323)..(323): n is a, c, g, or t
  modified_base (420)..(420): a, c, t, g, unknown or other
  misc_feature (420)..(420): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgagggaagcgccaccctctcctgctgggccagtcagagtgtagcaacacttagcctggtaccagcaagaaaccgtggccaggcctcccagacctcctctaatttatggtttcttctaccgaggggtcccngtcggtatccccgagccctaggttcagtcgcctaggtgggtccaggggacaggcgttcacttctcacctatcagccaagcctgcagtctagtaagtntttgtacttagttttatttcgtgtactagtactagttatacgtattaacgtcgggtctagttacgtaggtttcggaccgtagggacgtaagtcgtaaggaaaactacgaaaacggtacgtaggtcgctcgacaacgtatcgtctctctactcctacccg

SEQ ID NO: 336571 - DNA, 674 bp, Homo sapiens
  misc_feature: GZ8MTXP02HU9HC.45.72.G06.1.454.CMB.2.raw
  modified_base (201)..(201): a, c, t, g, unknown or other
  misc_feature (201)..(201): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaccattggagaaatactgatgacgcagtttccagccaccctgtctgtgtctccaggggaanagccaccctctcctgctgggccagtcagagtgttagcaaccacttagcctggtaccagcagaaacctggccaggcctcccagacctcctctatttatggtttcctttctaaccgaggggcccgctggtactccccgagcccgtaggtttcaggtcgcctaggttcggggtcctggggactaggtacgttcaccttctccacctatcagcagccctgcagtctagaacgttatttgtacttagttttactttcgtcgttacagtacgtagttattactaagttaaaccgttgggtaccttagttaacgttacgggtttttacgggacccggttaacgggggaaccctaaagggtaccgtaaagggtaaaacgttaaacgtaaaaccggtaaacgttacgggtaggtacccgttaggtaccgaacccgtattaccgttcggttacctttaccgtacctttacccggtttcccccg

SEQ ID NO: 336572 - DNA, 655 bp, Homo sapiens
  misc_feature: GZ8MTXP02JK1JG.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagagtgactactggagttggatcggcagccccgaggaaggcctggaatggattggctttgtactattatacgtggggtctaacctaacgttacaaaccccctcccttacaaagtacgtcccgggtaccaccgtaatttccgggtacgaccaaccggttcccaaaccgacggtcccttagttccctacccccgtagaaacgggttcaccgtaatttccgtcgtgtaacccgtcttcgggaccggtacttccggggcccgttagttacgttaccgttgtacggccgtaagacgttccgaattgggaataggtacgcgtttgggtattacgttagtcggtttaactttcggaacttcggtacggggcccgtaaggggcaaccggtcgtccgtacccggtctacccgtccgagtcccc

SEQ ID NO: 336573 - DNA, 570 bp, Homo sapiens
  misc_feature: GZ8MTXP02GRF1B.45.72.G06.1.454.CMB.2.raw
  modified_base (314)..(314): a, c, t, g, unknown or other
  misc_feature (314)..(314): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaagagccaccctctcctgctgggccagtcagagtgttagacaaccacttagcctggtaccagcaagaactggccaggctccagactcctctattatgttctctacgagggccnctggtactcccagtcccgaggttcaggtcgccgaggtcggtccgtagggacagtacgttcacttcncaacngtcancagcctncagtctagaaagtttntttacgactttagtttcttcgtgtacagtacgtaattatactaagtacgtgtactagtacgttggttacggacggtacggaacagtacgtaagaacttaacgaaacgtagtacggtacgacctacgaccaagtactcgttactctactacttccctc

SEQ ID NO: 336574 - DNA, 643 bp, Homo sapiens
  misc_feature: GZ8MTXP02IJJZC.45.72.G06.1.454.CMB.2.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagacgcgatcgacacgaccggtgctcgatttagctacgactgcaagggaaaggggggaactgctcagttaggacccagacggaaccatggaagccccagcgcagcttctcttcctcctgctactctggctcccagaaaccattggagaaatactgatgacgcagtttccagccaccctgtctgtgtctccgaggggaaanagccaccctctcctgctgggccagtcagagtgtagcaaccnttagctggaccngcagaactggccagcnccanctctnattngttctnaccngggccntgtactcccagcctaggttccagtcgccgtaggtcggggtctcggggactaggtacgtttccactcctacacctatcgagccagtccctgacagtctagtaagtagttttcgacgtttagttttatttccgtgtacctagtacgtaagttacttacgtaaagtttaaccgtgggtaccttagttaaaccgttagggttttacggacccggtaacgggggtaaacccaagggtaccgtaaagggtaaaactaccggtaaaacgtaaaccgtgggttacggaccgttcgacctaacctaactttcgttcgttacccttactaccgtttaccctttcccccgtacc

SEQ ID NO: 336575 - DNA, 577 bp, Homo sapiens
  misc_feature: GZ8MTXP02FNKK3.45.72.G06.1.454.CMB.2.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (404)..(404): a, c, t, g, unknown or other
  misc_feature (404)..(404): n is a, c, g, or t
  modified_base (544)..(544): a, c, t, g, unknown or other
  misc_feature (544)..(544): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaagcgccaccctctcctgctgggccagtcagtagtgttagcaaccacttagcctggtaccagcaagaacctgccagctccagctcctctattntgttcttcaccgngggccntggtactcccagccaggtcagtcgcgtaggtggtcctagggacagtattcaccttctccaccatccagccagtcctcgctagtctagtagttntttagtcttagttttatttctaggtacaggtactaagttactacgtaagttacgtcggtacttgtacgttaggtttcggacggtacggggaactaggtactaaggaatacgaaacgtacgtgcggtactcggactaaccngttacctcgttactaccgtactttcccgtaccg

SEQ ID NO: 336576 - DNA, 538 bp, Homo sapiens
  misc_feature: GZ8MTXP02F587I.45.72.G06.1.454.CMB.2.raw
  modified_base (383)..(383): a, c, t, g, unknown or other
  misc_feature (383)..(383): n is a, c, g, or t
  modified_base (516)..(516): a, c, t, g, unknown or other
  misc_feature (516)..(516): n is a, c, g, or t
  modified_base (528)..(528): a, c, t, g, unknown or other
  misc_feature (528)..(528): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgcccccgagggaacggcctggaatggatttggctttgtctattatacgtgggtcaccgaattacaacccctcctcaacgagtccggtcaccatttcggtcacacgtccaacncgaccttgttcctccctgaacggtgctacttctgtcggccgcgtgcggacgtcggccgtgtacttacgtgtcgcgagaatcgatgagtagtgcgtggttattacgtagttgttacttgactcgtggccaggcnccgtgcacgtcncgtcagtccg

SEQ ID NO: 336577 - DNA, 597 bp, Homo sapiens
  misc_feature: GZ8MTXP02IIMX0.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgccactgtctctcgtggtccatgagagtgactactggagttggatccggcacgccccgagggaacggcctggaatggattggcttttgtctattatcgtgggtcaccaattaccacccctcctacaagtacgtccggtaccaccgtatttcggcgacgacccgtccaaacacgtccttcgttccctccgtagtaaacggtgtactatttctgtcgaccgtcgtcggccggacgtccgggccgtgttatttacgtgtgacgtagacgtcgagtgagagtcgtcgttagttattactagttcggtttacttcgtacgtcggtcggggaccctaagggcgtcccgtcggtaccgtaccgtcgtcccgtacgacgttacccg

SEQ ID NO: 336578 - DNA, 657 bp, Homo sapiens
  misc_feature: GZ8MTXP02HJHVR.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagtccttcagagacccctgtcccctcacctgcactgtctctcgtggtccatgagaagtgactatggagttggactccggcacgccccgagggacggcctaggatggattggtctttgtctattatacgtgggtacacctaactaccacccctcctacaacgtagtcccggtaccaccgtacgtttcgacgtaccacgtccaacgtacgtccgttcgttcccgtccctagggtaacggtcgtactacttcgtcgtacgacccgtcgttcggccggtacgtcccgggtcgttacgttaacgtttcgtggtcgtacgtaagtaccgttgaagtggtaaggaggtacgtcgtttagggtttacttaactttaggtttacggtttaacgtttcgaccgttccgggttcggggaccgtacggggtacgtcccgtggtcccctaccggttcctccgtacgtaccgtaccccg

SEQ ID NO: 336579 - DNA, 730 bp, Homo sapiens
  misc_feature: GZ8MTXP02FNV4M.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacgccccccgagggaacggccgtggaactggattggctttgtctattatacgtggggtaccaccaacttaccaacccccgtccctacaaacgtacgtccgggtccacctagtttccggtcgaccacgtccaaacgacgccttcgttcctcccctagtaacggtcgtctacttctcggtacgtacccgtcgttcggaccggtaccgtccgggtcccgttagttacgtttaacgttcggttcggtaccggaaggtaaacgttaccggtaagtaggtaaggtaaggtttcggtaccgtttagggtttaaactttaaccgtttaaggttttacgggttttaacgtttacggttaacccggttcccgggttaccgggggtaacccggtaagggggtacccgggtccccgttccggggttacccgtaccccgggttcccttacccgttaccgtcggtttaacccccg

SEQ ID NO: 336580 - DNA, 713 bp, Homo sapiens
  misc_feature: GZ8MTXP02HWFPL.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccagtgagaagtgactactggagtggatccggcacgcccccagggacggccgtaggaatggagttggtacgtttgtacttattattacgttggggtacctaccgtaaattaaccgtaacccctcctaccgaaacggtacgtcccggggtacctacctacgtttaccggtcgtaaccgtaccgtccgaaacgtaacgtcctcgtttcctaccccgttagtaaacgggtctcgtaatttcgtaggtcgaacccgtcgtcggtccggtaaccgtccgggtccgttaggttaaactttccgttgtcggtaccgtaagaaacgttccgagtagaggtagtgtacgttaggtttatttaccgttagtttacggttttacgttaacggtccgttaccggttacgggggtacccgtaaaggggtaccgtaacccggttcggtaccgtacccgggttcttacccggtactaacgtttaacccccgg

SEQ ID NO: 336581 - DNA, 583 bp, Homo sapiens
  misc_feature: GZ8MTXP02IMSCF.45.72.G06.1.454.CMB.2.raw
  modified_base (204)..(204): a, c, t, g, unknown or other
  misc_feature (204)..(204): n is a, c, g, or t
  modified_base (414)..(414): a, c, t, g, unknown or other
  misc_feature (414)..(414): n is a, c, g, or t
  modified_base (498)..(498): a, c, t, g, unknown or other
  misc_feature (498)..(498): n is a, c, g, or t
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaancgccaccctctcctgctgggccagtcagagtgtacgacaaccacttagcctggtaccagcaagaaacctggccaggcctcccagacctcctctatttatcggtttctcaccgagggcctcgtcggtactcccagccctggttcagtgccgaggtggtcctgggactagtacgttcactctcaccatcagcacgcctgctgtctagtagtnttttgacttagtttttatacgtgtactagtactagttatactaacgttacgttgggccttagttacgttagggttccggaacgnggggtaacagtcgtaaagactacgaaacgtactggacggtactnaccgaactgttacgttntcctttaacgtcttcccttacccg

SEQ ID NO: 336582 - DNA, 676 bp, Homo sapiens
  misc_feature: GZ8MTXP02G30ZZ.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtcccctcacctgcactgtctctcgtggtccatgagaagtgactacgtggagttggactccgcacgccccgaagggacggccgtaggaacgtggatttggtctttggtacttagttactacgtcgggtaccaacctaaacttacccgaacccctcccgtacaaacggtcgtaccccgggtaccaaccgtacgtttccgggtacgaaccgaccgttacccgaaacaccgttcccttcgtttccctacccgttagtaacgggttcgacccttaagtttcgtggtccgaaccgtcgtcggccgtacgtcggtcgttagttacttacgtcgtaggacgtataacgtcgagtaggaagtcgtagtcgttagttaattacgttagttcggtttacgtcgtacccgttcggtacggggccgtaagggccgtccgtacggttccgtacccgttcgtccctacgtaaccgtccccg

SEQ ID NO: 336583 - DNA, 701 bp, Homo sapiens
  misc_feature: GZ8MTXP02JKR18.45.72.G06.1.454.CMB.2.raw
  modified_base (203)..(203): a, c, t, g, unknown or other
  misc_feature (203)..(203): n is a, c, g, or t
tcagacgcgatcgacacgaccggtgctcgatttagctacgactgcaagggaaagggtctctgaaggcttcacaagtcctgggacctcctgtgcaagaacatgaaacatctgtggttcttccttctcctggtggcagctccagatgggtcctgtcccaggtgcagttgcaggagtcgggcccaggacttgtgaagccttcaganacccctgtccctcacctgcactgtctctcgtggtccatgagagtgactacgtggagttggactccggcacgcccccgagggacggccgtaggaacgtggtagttggtctttgtacttattagtacgtgggtactaaccgtaaacttaccaacccctccctagtaaacggtacgtacccggtaccaccgtacgtttccggtacgaacctaccgtaccgaaaccgtacgtccctcgttaccctcccgtaggtaaacggttcgactaattccgtgtacgtaacccgtcgtcggaccggtacgtcccgggtacgttacgttaacgttccgtggtacgtacgaagtaaccgtagtagtaggaggtagtcgtagtttagttaacttacgttagtttacggtttaaacttcggtaccgttccgggttacggggacccggtacgggtaaccggtcccgtcgggttaccgtacccgttccgttacccgtaacgtccggttaaccccg

SEQ ID NO: 336584 - DNA, 712 bp, Homo sapiens
  misc_feature: GZ8MTXP02I6IGW.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtcccctcacctgcactgtctctcgtggtccatgagagtgactacgtggagttgatccggcacgcccccgaggacggccgtaggatggagttggtctttgtcttattagtacgttggggtacaaccgtaaactttaaccgaaccccccttacctaccgaaacggtacggttacccgggtacccaaccgttacgtttccgggtacgacccgtaaccgtcccgaaaccacggtacccttacgttccctcccgtaggtaaacgggtcgcttacgttcgtagtcgacccgtcgtcgccggtacgtccggccgttgttacgttacgttggtcgtacggtaagtacgttacgattaggaggtagtcgtccgtttaggtttaacttacgtttacgttacggttttaacgtttcggtaaccgtttccgggttcgggggaaccggtaggggtaaccggtcccggtttcggtaccgtacccgggttcctacccgttcgtaaccgtttcccccg

SEQ ID NO: 336585 - DNA, 591 bp, Homo sapiens
  misc_feature: GZ8MTXP02JIS1N.45.72.G06.1.454.CMB.2.raw
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtggtccatgagaagtgactactggagttggatccggcacgccccgaggggaacggcctgggaatggattggtctttgtctattatacgtgggtcacctataccacccctccncagcgtcggtcactnttcgcacncgcacagctntctcctagagtcgctacttcgtgtcgtacccgcgttcggacggtaccgtcgggtcccgttgttacttagtcggtgtaccgaagtaacgtcgagtgagtagtgcgttaggtttattacgttagttacggtttactttcgtaccgttccggtcgggggtacccgtaaggggtccgtcccgtggtacccgtaccggtctcccgtcgaacgttcccg

SEQ ID NO: 336586 - DNA, 580 bp, Homo sapiens
  misc_feature: GZ8MTXP02HLC6O.45.72.G06.1.454.CMB.2.raw
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (495)..(495): a, c, t, g, unknown or other
  misc_feature (495)..(495): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcggtggtccatgagaagtgactacgtggagttggatccggcacgcccccgagggaggcctggaagtggattggctttgtctattatacgtgggtcacctaattaccgaacccctcctcaagacgtcccggtcactagttcgtnacacgtccaacncgacctgttcctcccgtgaacgtgactatttctggtcgaaccgcgttcgcggtacgtccgggacgtgttaacttcgtagttgaccgtagagttacgagttggaagtgtntcgttagggttattactagttgttactttacgacttcggtcgggaccgttggacgtccgtggaccacgttctacctcgtagtccc

SEQ ID NO: 336587 - DNA, 622 bp, Homo sapiens
  misc_feature: GZ8MTXP02IV80Y.45.72.G06.1.454.CMB.2.raw
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctccccagatgggtcctgtcccaggtgcagttgcaggagtcgggcccaggacttgtgaagccttcagagaccctgtcccctcacctgcactgtctctcgtggtccatgagaagtgactactggagttggatccggcacgcccccgagggaaggcctaggaatggagtttggctttgtcttattatcgtggggtccaacctaattaccaaccccctcctacaagtacgtccggtccacctagtttcggtacgactaccgtccaaactacgccttacgttcctcccgtagtaacggtgctattcngtcgacccgngtcgcggtactcggccgtgttacttactggtgcgtagaagtcgaagttgaagtgtagtcgttaggttatttactagttaggtttactttcggtaccgttccggttcgggggaccccgaggggtaccgtcccgttcggggtacctacccggttctttcccgtacgtacgtccccg

SEQ ID NO: 336588 - DNA, 612 bp, Homo sapiens
  misc_feature: GZ8MTXP02G2NM6.45.72.G06.1.454.CMB.2.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaccattggagaaatactgatgacgcagtttccagccaccctgtctgtgtctccgaggggaaancgccaccctctcctgctgggccagtcagtagtgttacgacaacctacttagcctggtaccagcagaaacctggccaggcctcccagacctcctctatttactcggtttccttctaccgaggggccctctggtactcccgagcccgtaggttcagtcgccgtaggtggtcctagggactagacgttcacttcncaccntcagcagctgcngtctagatatttgacttgtttattctgtctagtactagttactactataacgtggtacttacgtacgttaggtttcggacgtaaggggacctaaggtcgttaaacggaaacttacgaaaaccggtaggttcggtacggtaccttacgacctaaccgttcttccggttacgttccttacggtaacctttcccgttaccccg

SEQ ID NO: 336589 - DNA, 706 bp, Homo sapiens
  misc_feature: GZ8MTXP02GG6A6.45.72.G06.1.454.CMB.2.raw
  modified_base (243)..(243): a, c, t, g, unknown or other
  misc_feature (243)..(243): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatganagtgactactggagttgatccgcacgccccgaggacggcaggatggattgctttgctattatacgtgggtacaaccgtaattacctaaccccctcctacaacggtacgtcccgggtaccaccgtacgtttccggtcgaacctacgtcccaaacgacggtccttagttccctacccgtagaaacgttcgacttacttcgtcgtcgaacccgtcgtacggtcccggtaccgtcccggggtaccgttagtttaaacgtttaacccgtggttaccggaccgggaaacgttaagttaccgaagtttggaaacggtggttaaggtccgtttaagggttttaattaaccgtttacgtttacgggtttaacctttcgtaacccggtttcggttaccgggggaccgtacgggggtaacctcccgttacggggtaccacccgtttccgtacctaccgtacggtttaacccccg

SEQ ID NO: 336590 - DNA, 806 bp, Homo sapiens
  misc_feature: GZ8MTXP02H5IKE.45.72.G06.1.454.CMB.2.raw
  modified_base (161)..(161): a, c, t, g, unknown or other
  misc_feature (161)..(161): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtncagttgcaggagtcgggccaggacttgtgaagccttacgagacgaccctgtccctcacctgcactgtctctcgtggtccatgagaagtgaactacgtggagttcggactccggcacgcccccgaaggggaacggccgtaggaagtggtagttggtcttttggtacttaagttaagtacggttcggggtactaaccgtaaactttaacccaaccccttacccgtaccgtaaacggtaccggttaccccggggtacctaaacccgtttacgtttacccgggttaccggaaaccgtaaccccggtaccctaaaaccgggtaactaccccgtttaccgggtttcccttacccccggttaaggtaaaccggttccgtaacgttaacgtttacgttcggttacccgaacccgtccgttacgggacccgttaaccggtcccgggtacccgttagttaaaccgttccgttaacggttggtaaccgaaagtaacgtcgtagtacggagtaggtgtactttagggtaaattaacgtttagtacggtttttacttacgttaacccgttcggttaacggggtccgtaacggggaccgttcccggtccggttaacccgtacgggttaccctttcccgacccgtacggtttaacccccg

SEQ ID NO: 336591 - DNA, 763 bp, Homo sapiens
  misc_feature: GZ8MTXP02G4YPV.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgacccctgtccctcacctgcactgtctctcgtggtccatgagaagtgactacgtggagttggatccggcacggcccccgagggaacggcctaggaatggattggtctttgtcttattagtacgtggggtcaaccgtaattaccaacccctcctacaagtacgtcccgggtacacctagttccggtcgaacctacgtccaaacgcgtccctacgttcctaccccgtaggtaaacggtcgtacctaagtttccgtggtaccggacccgtccttacgggcccggtaaccgttccggggtacccgttaggttaaacgtttaccgtggttcggaaccggtaagtaaacgtttaccggaagtttacgggaaaggtaacggttggtaccgtttaggggttttaaaccgtttaacgtttaaggtttaccgggtttttaaacgtttccgggttaaacccgttacccgggttcgggggtaacccccgttaaagggggtaccccgtcccggtttaccggggttccctaacccggtttcccgtccccgttaccgggtaactttaccccccgg

SEQ ID NO: 336592 - DNA, 780 bp, Homo sapiens
  misc_feature: GZ8MTXP02FGEQV.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcacggccccccgaaggggaacggcctagggaatggagtttggctttggtctattataacgtggggtacaaccctaaattaccgaaacccccttccctacaaacggtacggtacccggggtccaaccgtagtttccgggtaccgaccaaccggtccaaaccgaacgtcccttacgtttaccctccccgttaggaaaacgggttcgacctaagtttcccgtaggttcggaacccgttccgtggaccgggtaaccgtccgggtacccgttaggttaaactttaccgaggttacggaccggaaagtaaaaccttcgggaattaggaacggtaacggtgtaccgtttaggggttttaaacttaaccgtttaaggtttacgggtttttaaaaccgtttttcgggtaaacccgtttacccgggttacggggggtacccccgtaagggggaaacccgtaaccccgttcgggggtacccctaacccgggttcctaaccccttccggaaccgtttacccccg

SEQ ID NO: 336593 - DNA, 544 bp, Homo sapiens
  misc_feature: GZ8MTXP02GMY00.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccagggacttgtgaagccttcagagaccctgtccctcacctgcactgtctctcgtgggtccatgagaagtgactactggagttggatccggcagcccccagggaacggcctggaatggattggctttgctattatactggggtcaccaattacaacccctcctcaagagtccgggtcacctatttcggtcgacacgtccaaacagcctagttctccctgaagtgcattctgtgaccgctgcgacgtcgccgtgtattacgtgtcgacgagactcgattggagagtgcgtggttattacgtattggttactttgactcgtacggggtccaggggactcccgtgtctaccgtctaccgtcacgtccc

SEQ ID NO: 336594 - DNA, 686 bp, Homo sapiens
  misc_feature: GZ8MTXP02JLKCS.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagagtgactacgtggagttggatccggcacgccccgagggaacggcctaggagtggtagttggtctttgtacttagttatacggttggggtacctaacctaacttaaccctaaccccctcctacgaaacggtacggtccccggtaccaccgttacgtttccggtaccgaacctaccgtcccaaacgacgtcccttcgttccctacccgtaggtaacggtctacctagttcgtggtccggccgtcgtcggaccggtacgtccggtaccgttagtttacgttccgtggtcgacgtaagtaagtcgaagtggaagtagtcgtcgttaggtttacttacgttagtttaggtttacgtttacggtaccgttccgggtacgggtaccgaacgggtccgtaacccggttcggtacccgttacccggtcctaccgtccgtacgttacccccg

SEQ ID NO: 336595 - DNA, 640 bp, Homo sapiens
  misc_feature: GZ8MTXP02HDJMZ.45.72.G06.1.454.CMB.2.raw
  modified_base (375)..(375): a, c, t, g, unknown or other
  misc_feature (375)..(375): n is a, c, g, or t
  modified_base (436)..(436): a, c, t, g, unknown or other
  misc_feature (436)..(436): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctcgtggtccatgagagtgactacgtggagttggatccggcacgccccgagggacggccgtggaatggattcggctttgtactattatacgtgggtcctaaccgtactacgaaccccctcctacgaagtcgtcccggtactacctntttccggtacactacgtccaacctaggtacctcgttcctccctaggtaaggtcactattcnggttcacccgtctaggccggtacgtccgggtccgtgttatacgttgtcgtccgagtaacgtacgtagtacgagtagtagtccgtttaggtttaattaccgttaaggttcggtttacgtttacgaaccgtttcggtccgggggtacgacgggtaaccgtcccgtaggttcccgtaccggttcctacccgtacggtccttaacccg

SEQ ID NO: 336596 - DNA, 670 bp, Homo sapiens
  misc_feature: GZ8MTXP02GFF2N.45.72.G06.1.454.CMB.2.raw
  modified_base (218)..(218): a, c, t, g, unknown or other
  misc_feature (218)..(218): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgacccctgtcccctnacctgccactgtctctggtggtccatgagaagtgactctggagttggactccggcacgccccgagggacggcaggagtggagtgtctttgtcttattatacgtgggtacacctaaacttacctaacccctccacgaagtacgtccggtacaccgtagttccggactaccacgtccaacacgtccttccgttcctcccgtagtaaggttcgacttaactttcgagttaccggacgtcgtcggtaccggccgttcgggacccgttagttacgttacgtgtacggtacgagtaacggttacgagtggtaaggtggttacggtacgtttaaggtttaacgttaacgttaagtttcggttttaaaccgttcggtaaccgttccgggtacgggggtaccgtaaggggtcgtaacccgttcgggtaccctaccggtccgtcctaccgaacgtttccccg

SEQ ID NO: 336597 - DNA, 658 bp, Homo sapiens
  misc_feature: GZ8MTXP02JYS2L.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtcccctcacctgctactgtctctcggtggtccagtgagagtcgactcgtggtagttggactccggcacggccccgagggacggcgtaggagtggtagttgtctttgtactatagtacgtgggtaccaacctactacccacccctccgtacacggtacgtcccggtactaccgtacgttccggacacgtacgtccaacgtacgtcccttcgttccctaccgtaggtaacgtcgtacttattccgtagtaccgccgtcgcggaccggtcgtcggtcgttcgttacgttacgtggacgtacgtaagaggtacgtagtcggaagtggttacgtcgtttaggttaacttatttaggttacgtttacgtcggtaccgtccgggtcgggaccgtcgggtaaccgtccgtaccggggttacctacccggttcctaccctacggtaccgtaccccgg

SEQ ID NO: 336598 - DNA, 642 bp, Homo sapiens
  misc_feature: GZ8MTXP02I8EUC.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcagggagtcgggcccaggacttgtgaagccttcagacgaccctgtcccctcacctgccactgtctctcgtgggtccatgagaagtgactactggagttggatccggcacggccccagggacggcctggaatggattggctttgtctattactacgtggggtcaaccgtaacttaccgaaccccctcctacaagtacgtccgggtccacctactttaccggcaccgacgtcccgaacacgtccttacgttcctcccgtagaacggtgctattccgtgtcgacccgtcgtacgtccggacgttcggggtcctaggttaacttccgtgtaggtcgaagaacgttcggattaggaaggtacgtggaccgtttagttacgttacgttagttcggtttacttcggtaccgttccggtacggggtcccgaggggtacggtccccgtggttacccgcccggttcctaccgtcgtacgttcccg

SEQ ID NO: 336599 - DNA, 646 bp, Homo sapiens
  misc_feature: GZ8MTXP02H2VI1.45.72.G06.1.454.CMB.2.raw
  modified_base (437)..(437): a, c, t, g, unknown or other
  misc_feature (437)..(437): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcagggagtcgggcccaggacttgtgaagccttcagagacccctgtcccctcacctgcactgtctctcgtgggtccatgagaagtgactacgtggagttggatccggcacgcccccgaggaacggcctggaatggattggtctttgtctattatacgtgggtcactaattaccaacccctcctacaagcgtccggtacacctattcggtacacacgtccaaacacgtcctcgttcctacccgtgaacgtcgacctattctagtcgacccgngttcggcgtaccgtccggtaccgtgttaacttcgtgtagtcgaagtaacgtgagtagaagtggtagtcgttaggttaacttaacgttagttacggttttaactttcgaacccgtttccggttacgggggccccgtaaagggggtaccgtccccggttacggttacccggtacccggttcccttcccgttaccgtaaccggttacccccg

SEQ ID NO: 336600 - DNA, 671 bp, Homo sapiens
  misc_feature: GZ8MTXP02JYWYR.45.72.G06.1.454.CMB.2.raw
  modified_base (257)..(257): a, c, t, g, unknown or other
  misc_feature (257)..(257): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagttccagccaccctgtctgtgtctccgaggggaaagcgccaccctctcctgctgggccagtcagagtgtagcaaccactagcctgtaccngcaagaacctggccaggcctccagacctcctctatttagtggtttctttctaccgacggggtccgcgtcggtactccccgaggcccgtaggttcagtcgccgtaggttcggggtccgtcggggactaggtacgttcgaccttcgtccaaccgtacttacccgagggtccaaccggtccctcggactaacggttacgtagtaaacgtttattttcggacttaggttttactttcgtgtactagtactaagttactacgtattaacgtcggttaccgttagttaccgtttacgggtttcgggaaccggtagggggtaacccaaggtacgttacgaaaagttaccaaaacggtcggttagtcgggtactacgaccctaacgtacttcgtacgtttccttacctcgtttcccctaccg

SEQ ID NO: 336601 - DNA, 611 bp, Homo sapiens
  misc_feature: GZ8MTXP02FVUEM.45.72.G06.1.454.CMB.2.raw
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (611)..(611): a, c, t, g, unknown or other
  misc_feature (611)..(611): n is a, c, g, or t
tcagacgcgatcgacacgaccggtgctcgatttagctacgactgcaagggaaagggtctctgaagccttcagagaccctgtccctcacctgcactgtctctcgtgggtccatgagaagtgactactggagttggatccggcagcccccagggaaggcctggaatggattggctttgtctattatactggggtcaccaattacaacccctcctcaagagtcgggtcaccatttcggtcgacacgtcaacagcctgttctccctgaaggtgctattctgtgaccgntggcggactcggcctgtattactgtgcgagaatcgatgagngtgcttggttatactagtggtttacttcgacgtccgtggggcaggggacnccgtggtcaccgttctcctcacgtcttacccaccgaaacggcccctactccgggtaccctttcccccgtggcccgtccctgtcctaccgaggaacgtccaacccgttcgggacggggtccacgacggcccggcccggttgggcctacggccgtacggtacgaacggtacttccgtttccgcgtctccggtcgttacgcggtacggcgggtcgacgggaccgagggcgcaaacggtn

SEQ ID NO: 336602 - DNA, 527 bp, Homo sapiens
  misc_feature: GZ8MTXP02HDN71.45.72.G06.1.454.CMB.2.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (370)..(371): a, c, t, g, unknown or other
  misc_feature (370)..(371): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggtacttgtgaagccttnagagaccctgtccctnacctgcactgtctctcgtgggtccatgagaagtnactatgagtgatcggcacgccccaggaacggtcnggaatggatggcttgntatanagtggtnacaatacaccctccanagngccgacactgtcgacacacncaancnctntcncgagagnntntntgcgcgcgcgcgacgtcgtcgtagtagtagtgtgagagagtagtagtagagagtgtagttagttaagttaagttacgttagttacgttacgtacgtacggtacggacggacggacgtccgtcgtaccgtaccgtcctccgtacgtacgtacg

SEQ ID NO: 336603 - DNA, 650 bp, Homo sapiens
  misc_feature: GZ8MTXP02HHAHO.45.72.G06.1.454.CMB.2.raw
  modified_base (203)..(203): a, c, t, g, unknown or other
  misc_feature (203)..(203): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagacgcgatcgacacgaccggtgctcgatttagctacgactgcaagggaaaggggaggaactgctcagttaggacccagacggaaccatggaagccccagcgcagcttctcttcctcctgctactctggctcccagaaaccattggagaaatactgatgacgcagtttccagccaccctgtctgtgtctccgaggggaaancgccaccctctcctgctgggccagtcagagtgttagcaacctacttagcctaggtaccagcagaaccgtggccaggcctcccgagacctccctatattttacgtcggttttccttacccgtaacccggtacggggtcccctcgttacgggtacctacccccgtaggccccttaagggtttccaacggttccgacccgtagggttcgggtacccgtggggaccaggtacgttcaccgtcctcacctatccagcacgtcctgcagtctagtaagtntttagnttagtttacttctgtcagtctagttactactagtacgtggtactacgttacgttaggtttacggaccgtacggggaacctacggtaccggtaagtaaaacgttacgaaaccgtagttacggcggtactcgtacaactcgtcgtactcttactacctttccgtacccc

SEQ ID NO: 336604 - DNA, 531 bp, Homo sapiens
  misc_feature: GZ8MTXP02F5P80.45.72.G06.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
  modified_base (406)..(406): a, c, t, g, unknown or other
  misc_feature (406)..(406): n is a, c, g, or t
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagccaccctgtctgtgtctccaggggaaanagccaccctctcctgctgggccagtcagagtgttagcaaccacttagcctggtaccagcaagaacctggccaggctacccagacctcctnatttangtttctcaccagggccntggatcccagcagtcatgcagtggctgggacagngttcactcgtcacatcagcagcctgcagtctagagtatttgactagtttattcttntactagactagtatactatacgtggtactctagtagtttcggacgtacgggaccaagctaggaaactacgaaacgtacgtagtacgacgtgacaactatctcgtactttcgacttctttaccccg

SEQ ID NO: 336605 - DNA, 577 bp, Homo sapiens
  misc_feature: GZ8MTXP02G69OL.45.72.G06.1.454.CMB.2.raw
  modified_base (423)..(423): a, c, t, g, unknown or other
  misc_feature (423)..(423): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtgggtccatgagaagtgactactggagttggatccggcacgcccccagggaacggcctggaatggattggactttgtctattatacgtgggtcacctaattacacccctcctcaagtacgtccggtcacctattcggtcgacacgtccaacagcctagttctccctgaagtcgctattctgtcgaccgtcngccggactccgggaccgtgtattacgtgtcgtcgagtaagtcgagtacggagagtgcttgggtttattacgttaagttcggtttacgtttcgacgttcgtcgggggaccctaggggacgtcccgtggtacccaccggtacctcctctacgtccc

SEQ ID NO: 336606 - DNA, 686 bp, Homo sapiens
  misc_feature: GZ8MTXP02GBVPG.45.72.G06.1.454.CMB.2.raw
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgacccctgtccctcacctgcactgtctcgtcgtggtccatgagaagtgactacgtggtagttgacgtccggcacggcccccgaagggaacggccgtaggaagtggtagttggtctttgtactagtttacgtacggttcgggtactaaccgtaaacttaacccgtaaacccccttacctacgaaacggtacggtacccgggtaccctaaccgtgtttaccggtccgaaccgttaccgtccaaacgacgtccgttcgttaccctcccgtagggacgtcgtacgtattcgtcgtacgtacccgcgtcggcggtacgtccgggtccgttagtacttcgtgtcgacgaagtactacgaatggtaagtgtgttcgttaggtttacttacgttacgtttagtttacgtttacggtaccgttcgggtcgggtacccgaaggggtaccgtcccggtacgttccgtaccgttcctcctacggtcgttaccccg

SEQ ID NO: 336607 - DNA, 665 bp, Homo sapiens
  misc_feature: GZ8MTXP02FFMDA.45.72.G06.1.454.CMB.2.raw
  modified_base (260)..(260): a, c, t, g, unknown or other
  misc_feature (260)..(260): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtcctcacctgccactgtctctcgtcgggtccatgagaagtgactactggngttgatccgcagccccaggaaggcctggaatggatttggctttgtctatttagtacgtggggttccaacctaaagttaaccaacccccttcccacgaaacggtacggtaccccggggtccaacctaagttttccgggtccgaaccacggttcccaaacgacgaccttcgttcctacccgtgtaaacggtcgacgtaacttcgtacggtcgacccgtcctcggtacggtaacctcgggacccgtgttaattaccgtgtgacgagtaactcggataggagtagtcgtacgttaggttacttaactagttggttaccttttagaccttccgggtacgggggtacccaaggggtaccgccccgttaggtacccgtacccggttccctttaccgccgtacggtttccccc

SEQ ID NO: 336608 - DNA, 558 bp, Homo sapiens
  misc_feature: GZ8MTXP02JRNP2.45.72.G06.1.454.CMB.2.raw
  modified_base (425)..(425): a, c, t, g, unknown or other
  misc_feature (425)..(425): n is a, c, g, or t
  modified_base (545)..(545): a, c, t, g, unknown or other
  misc_feature (545)..(545): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtcccctcacctgcactgtctctcgtggtccatgagaagtgactacgtgagttggatcggcacgcccccgaggacggcctggaatggattggctttgtctattatacgtggggtcaaccgtaacttaccaacccctccctacgaaaggacgtccgggtacacctacgttcggtacacacgtccaaacagtcctagtcctacctgaagtgctattcngtgaccgctgcgactcgtctcgtatactgtgacgagaagtcgaagtgagacgtgcttaggtaatagtagtagttcttagcgttccgtgggcccgaaggcgtaaccgtggtaccaccggtntccttcacgtccc

SEQ ID NO: 336609 - DNA, 622 bp, Homo sapiens
  misc_feature: GZ8MTXP02F3T4W.45.72.G06.1.454.CMB.2.raw
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
  modified_base (518)..(518): a, c, t, g, unknown or other
  misc_feature (518)..(518): n is a, c, g, or t
  modified_base (577)..(577): a, c, t, g, unknown or other
  misc_feature (577)..(577): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagacgaccctgtccctcacctgcactgtctctgtggtccagtcgaagtagtgtactactggtagttggactccggacacgcccccgaagggaacggctaggaatggattggtctttgtactattatacgtgggtacactaacgtaccaaacccctcctanaaacgtcgtcccgggtacctaccgtaacgtttcggacgaaccaccgcccaaacacgccttacgtcctaccgtgaaaggtcnctaattctggtacgccgtcncggtaccgacgtcggtaccgtattaattccgtgtcgacgataacgtcgatgagcgtancgttagttatactagttacgttagttacgtccgtacgttcggggaaccagggggtaccncccggttcgtaaccgtacccggttactacctctaacggtttaccc

SEQ ID NO: 336610 - DNA, 585 bp, Homo sapiens
  misc_feature: GZ8MTXP02FJVZ7.45.72.G06.1.454.CMB.2.raw
  modified_base (338)..(338): a, c, t, g, unknown or other
  misc_feature (338)..(338): n is a, c, g, or t
  modified_base (377)..(377): a, c, t, g, unknown or other
  misc_feature (377)..(377): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagacccctgtccctcacctgcactgtctctcgtgggtccatgagaagtgactactggagttggatccggcagcccccagggaggcctggatggattggctttgtctattatactggggtcaccatacaacccctccncacgagtccggtcaccatttcgtcgacacgtccaacacncctgttctccctgacggtgcattctgtgaccgctgcggtacgtcggtccgtgttagttaccgtggttagccgaggaaacgtcgtagttggacgtaaggtgcgttggtttactttacgtacttggtttaacctttcggtacttaccgtcgggggtacccgtaggggtacggccccgtggtcgtacccgtacgtccaccgtcgtaccccg

SEQ ID NO: 336611 - DNA, 596 bp, Homo sapiens
  misc_feature: GZ8MTXP02FG9FB.45.72.G06.1.454.CMB.2.raw
  modified_base (378)..(378): a, c, t, g, unknown or other
  misc_feature (378)..(378): n is a, c, g, or t
tcagacgcgatcgacacgaccggtgctcgatttagctacgactgcaagggaaagggtctctgaaggcttcacaagtcctggacctcctgtgcaagaacatgaaacatctgtggttcttccttctcctggtggcagctcccagatgggtcctgtcccaggtgcagttgcaggagtcgggcccaggacttgtgaagccttcagagaccctgtccctcacctgcactgtctctcgtggtccatgagaagtgactactggagttggatccggcagccccccgagggaacggcctggaactggattggctttgtctattatatggggtcaccaattacacccctcctcagagtcggtcaccattcggtcgacacgtccaacanctgtctcctgagtgcattctgtgacccgctgccggactcggccgtgtattacgtgtgcgagtaatcgacgtgaggagttgacgttaggtttaacttaacgtattacgggtttacgtttacgaaccgttccgtacgggggtccccaagggggtaacccggtcccccgttgggttcccgtaaccccggttcccttacccgttccgaaccggtttaccccg

SEQ ID NO: 336612 - DNA, 658 bp, Homo sapiens
  misc_feature: GZ8MTXP02H6M0X.45.72.G06.1.454.CMB.2.raw
tcagacgcgatcgacacgaccggtgctcgatttagctacgactgcaagggaaagggggaggaactgctcagttaggacccagacggaaccatggaagccccagcgcagcttctcttcctcctgctactctggctcccagaaaccattggagaaatactgatgacgcagtttccagcccaccctgtctgtgtctccgaggggaaagagccaccctctcctgctcgggccagtcagagttgttagacaacctacttgccgtggtaccagacaacgtaaacctcggaccacggcctcccacgtacctccgtactattttagtacggtttccttactaccgacgggtccctcgttacgtactacccgacggtcccgtaggttaccgagtccgcgtacgggtcgggtccgtacggggactaggtactcaccgttcctccaccgtataccacgtccacggtcctagcgtatccgtagtagttatttgtcgttaagttttctttcgtagtccaggtactagttaactaccgtaagttaacctcggggttacttacggttacgttacggtttcgggaccgtaacggggtaacagtaccgaggtaaaactacgaaacgtaagtcgtcgctacgacgctacgttcgtctactctacgttaccctcccg

SEQ ID NO: 336613 - DNA, 484 bp, Homo sapiens
  misc_feature: GZ8MTXP01EM97F.39.70.G04.1.454.CMB.2.raw
  modified_base (462)..(462): a, c, t, g, unknown or other
  misc_feature (462)..(462): n is a, c, g, or t
  modified_base (469)..(470): a, c, t, g, unknown or other
  misc_feature (469)..(470): n is a, c, g, or t
  modified_base (472)..(484): a, c, t, g, unknown or other
  misc_feature (472)..(484): n is a, c, g, or t
tcagtcgcactagtcacgaccggtgctcgatttagtgtagtgtgaagggaaaggggctggagtggatttcatacattagtagaaatggaaattccatatactacgcagactctgtgaagggccgattcaccatctccagagactattccaagagcactctgtatctgcaaaatgaacagcctgagtgccgaggacacggcctatattattgtgacgaaatggtggggggagtgggggctacgtccgtggtcgtttgactacgtggggccgagggagccctggtcaccgtctcctcacgccctaccgaccgaacgggcccctagtccggtccttccccccgtggcccgcccctgccctccgaggcgccacccgtccgagaccgcacgagccggcccgtgggctggcctgggtacaacggtacctactccatagtgcgactggagcgggctcggcgaagggccnaagtagnngnnnnnnnnnnnnn

SEQ ID NO: 336614 - DNA, 499 bp, Homo sapiens
  misc_feature: GZ8MTXP01BK40S.39.70.G04.1.454.CMB.2.raw
  modified_base (370)..(370): a, c, t, g, unknown or other
  misc_feature (370)..(370): n is a, c, g, or t
  modified_base (475)..(475): a, c, t, g, unknown or other
  misc_feature (475)..(475): n is a, c, g, or t
  modified_base (477)..(499): a, c, t, g, unknown or other
  misc_feature (477)..(499): n is a, c, g, or t
tcagtcgcactagtcacgaccggtgctcgatttagtgtagtgtgaagggaaaggggctggagtggatttcatacattagtagaaatggaaattccatatactacgcagactctgtgaagggccgattcaccatctccagagactattccaagagcactctgtatctgcaaatgaacagcctgagtgccgaggacacggccctatattattgtgcgaaatggtggggggagtgggggctactcctggcgttttgactacgtggggccagggacgccctggtcaccgtctcctcacgcctccaccgaagggccccatccggtccttccccctggccgcccctgcctccgaggcgccacctcgagacgccacncggccgcccgtgggctcgcccgtgggtaccaacgggtaccttacgttcccaacgttagtcgccgaactggaacggcggggctggggacaaggggcacgatagcgngnnnnnnnnnnnnnnnnnnnnnnn

SEQ ID NO: 336615 - DNA, 508 bp, Homo sapiens
  misc_feature: GZ8MTXP01EAWO3.51.55.E11.1.454.CMB.2.raw
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (418)..(418): a, c, t, g, unknown or other
  misc_feature (418)..(418): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcaccttgctctggagatgcattgaccaaacgntatgcttatggtaccagcagaagccggcaggcccctgtgttgngatgtataaagacactgagaggccctcgagggatcccgtgagcgattctctggctcagtcaagggacaacggtcacattggaccatcgagtggagtccgaggcaggaggacgagctagacttatatgtacaatcaanagacacattgtacttatgtctgactgcacaagtcaccgtctggttacgcgcccaaggccccaacccactgttcctaaccgttcttccccg

SEQ ID NO: 336616 - DNA, 555 bp, Homo sapiens
  misc_feature: GZ8MTXP01EZDKU.51.55.E11.1.454.CMB.2.raw
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattgaccaaacgntatgcttatggtaccagcagagccggcacggccctgtgttggngatgtaataaagacactgagacgcctgagggactccgtgagcgtattcgtcctggctaccgaggtcgaaacgggaacaacggnactagttcgcgtacncgagtcggacgtcgaggcaggaggagagctagactattnttagacaactacaaagacacacctagttagttacttaagtcgtacgtacgtactaggcgtaacgacggtccgttacgtccgtaggccgacgacccgaacgaccccaaccctctcggttacctaaccgttccttcccg

SEQ ID NO: 336617 - DNA, 509 bp, Homo sapiens
  misc_feature: GZ8MTXP01ETOXD.51.55.E11.1.454.CMB.2.raw
  modified_base (219)..(219): a, c, t, g, unknown or other
  misc_feature (219)..(219): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagcgatcgtatacacgaccggtgctcgatttagcactcgcacgttgggtttgggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaacgatatgcttatggtaccagcagaagccggcaggccctgtgttggtgatgtaataaagacactgagaggccctgagggactcccgtgagcgattctctggctcgagtcaagggacaacggtcacattggcatcagtgagtccaggcagagacgagctgactatatgtanaatcaanagacactatcgtattatgtcttacggaactgcgaacgaggtccncgtaccgtgggttcacgccccaaggccccaacccnctacnctaaccgttcgttcccg

SEQ ID NO: 336618 - DNA, 623 bp, Homo sapiens
  misc_feature: GZ8MTXP01EEXK4.51.55.E11.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatggaccagcagaacgccggcacggccctgtgtggtgatgtaataaagacagtgagacggccctgagggactccgtagagcgtattctccgtggctccgaggtcgaaacgggaacaacggtcaactagttcggcctagtcgagtggacgtccgagggacgaaggacgggaacgaggtcgtagtaacttagtttattagtactaaagtacaaacgtacgaacctacctaagtttcggttaactttagttcgttacgttacggtaaacttcggaaccgtaaccgttaacgggtcccttaaccgggttccgtacgggttaccgaccggaccccgaacggcccctaaccccgtactcgttacctaaccttccgttaaccccg

SEQ ID NO: 336619 - DNA, 542 bp, Homo sapiens
  misc_feature: GZ8MTXP01BJW3E.51.55.E11.1.454.CMB.2.raw
  modified_base (237)..(237): a, c, t, g, unknown or other
  misc_feature (237)..(237): n is a, c, g, or t
  modified_base (519)..(519): a, c, t, g, unknown or other
  misc_feature (519)..(519): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagcggcagccctgtgtggtgatgtataaagacactgagaggccctcgagggactccgtgagcgtattctcgtggctccgaggtcgaacgggacaacggtcacgtagttcggaccatacgagtaggagtaccgaggcgaggagggacgaggctagacttattatagtacaagtcaaacgagaacactagttgtacttagtgtcttacgactgaacgacgttacgtccgaccgtcgtggttacgacgacccgaacgacccaacccnctcgcctaaccttcgttaacccc

SEQ ID NO: 336620 - DNA, 542 bp, Homo sapiens
  misc_feature: GZ8MTXP01BMWAY.51.55.E11.1.454.CMB.2.raw
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacacccaccctcggtgtcagtgtccccaggacagacggccaggatcacctgctctggagatgcattgccaaacgntatgcttatgtaccagcagaagcggccaggcccctgtgttggtgatgtataaagacactgagaggccctgagggatccctgagcgattctctcggctcaggtcaggaacacgggtnacattggccatcagtggagtccaggcaggaggacgaggctagactattatgtacaatcaaacagacacctattggtacttatcgtcttacgggaactgccgaaccgtaaaggttcaacccgttcgtcggggtcacggccccaaggccccaaaccccgtaactcggtccaccttcgttccggtttcccccg

SEQ ID NO: 336621 - DNA, 625 bp, Homo sapiens
  misc_feature: GZ8MTXP01CLLQX.51.55.E11.1.454.CMB.2.raw
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctggtgtcagtcgtcccaggacagacgcagatcacctgctcgtggagatgctattgaccaaacgntatgacttatgtacagcagagcggcacgcctgtgtgtnatagtaataaagacagtgagacgcctagagggctccgtgagcgtattcgtccgtcggctccgaggtacgaaacgggaaccaacggtacacgtagtcggacagtacgaggtgacgtacgaggacaggaacggacggagctagtacttaattagttacgtaactaacgtaacaaacaacgaactaaccgtagttaacggttactttaacgtcgttaccgtaacggtaaccgttaggaacccgtaaaccggttaaacgggtcccacccggttaccgtacgggacccgaccgggacccgaaaccggacccctaaccccgttacgtaccgttacctaacccgttccgtttcccccgg

SEQ ID NO: 336622 - DNA, 594 bp, Homo sapiens
  misc_feature: GZ8MTXP01AQ29G.51.55.E11.1.454.CMB.2.raw
  modified_base (237)..(237): a, c, t, g, unknown or other
  misc_feature (237)..(237): n is a, c, g, or t
  modified_base (429)..(429): a, c, t, g, unknown or other
  misc_feature (429)..(429): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccacggcccctgtgttggtgatgtaataaagacactgagaggccctcgagggactcccgtgagcgattctccgtggctccgaggtcgaagggacaacggtcacagttcggcatcagtggacgtccaggcaggaggacgagctgactattatgtacaagtcaanagacacctattggtacttagtcgtcgttacggaacttggaaccgtaaccgttaagggtcccttaacccggttcccgtcgggggttacccaaccgggacccccgaaacggggtaccccccaaaccccgtaccgttcggttaccctaacccttcccgtttcccccgg

SEQ ID NO: 336623 - DNA, 717 bp, Homo sapiens
  misc_feature: GZ8MTXP01CNO5N.51.55.E11.1.454.CMB.2.raw
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgacttatggtaccagcagagccggcacggccctgtgtggtgatagtataaagacacgtgagacggcccctgagggactcccgtgacgcgtatttcgtccgtggctccgaggtcgaaacgggggaccaacgggtcaacgtagttcggaccctagtcgaagggtcgggaacgtcccgaagggccgaagggaacgggacggtaggacgtggaactttagtttaacgttagtaccaaacgttacaaaccgtacgtaaacccaacccgttaagtttacgggtttaacctttaagttaccggtttaccgttaccgggtaaaccgttgggaacccgtaaacccggttaaaggggttccccgttaaaccccggttcccgggttacggggttaccccgttacccgggacccccgtaaaaccggggacccccctaaaacccccggtcttacccggttaccctaaccctttcccgttttccccccg

SEQ ID NO: 336624 - DNA, 756 bp, Homo sapiens
  misc_feature: GZ8MTXP01BX3KD.51.55.E11.1.454.CMB.2.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
tcagcgatcgtatacacgaccggtgctcgatttagcactcgcacgttgggtttgggggggtccaggaggcagaactctgggtgtctcaccatggcctggatccctctacttctcccctcctcactctctgcacaggctctgaggcctcctatgagctgacacagccacctcggtgtcagtcgtcccaggacagacggccaggatcactgctntgganatgcattcgaccaaacgntatgtacttatggtaccagcagaagccggcacggccctgtgttggtgatgtataaagacacgtgagacggcccctacgacggggacttcccgtagacggacgtacgtttccgtccgttcggtcctacccggtagggttccggaaacggggaaacccgtaaccggggttccaaccgtaacgtttcggggacccctaagtacccgtaagggttacgggacgttacccggaagggaccgaaaggaacggggaaacccgggagggtaccgttaagggtaaaccttaaagtttaacgtttaggttaaccccgtaaagttaacccgtaaaactaacggaaccctaaacccgtaagttttacgggttaaccttttaaagttcggtttaccttaacgggtaaaccgtttcggaacgtaaaccggttaacggttaccgaccccgttaccggtcggttaccggaacggacccccgaaaggtacccccaacccctacggttacgttaccgtaacctttccgtttaacccccg

SEQ ID NO: 336625 - DNA, 686 bp, Homo sapiens
  misc_feature: GZ8MTXP01C7J01.51.55.E11.1.454.CMB.2.raw
  modified_base (175)..(175): a, c, t, g, unknown or other
  misc_feature (175)..(175): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctctatgagctgacacagccaccctggtntcagtcgtcccaggacagacgcaggatcacctgctgtgganatgctattcgaccaaacgtntatgtcttagtgtaccagcagacgccggcacgcctgtgtggtgatagtaataaagacacgtgagacgcctacgaggactccgtgacgcgtattctccgtggtctacgaggtaccgaaacgggtaaccgtaaccggtactacgtagttcgacctagtcgtaagggtcggtacgtaccggaacgggacgaagggaacgggaacggtacgggacttacggtaaacttaagtttaattacggtaacctaaacgtaaacaaaacgaacgtaaccaacgttaacgtttacgggttaaactttaacggttacgtttaccgttaaccggggtaacttcgggaaacccgtaaccggttaaacggtacccgttacccggttaccggttacgggttacccgaccgaccccgaaaccgtaccccgaaccctacgtccgttactaacccttccgttaaccccg

SEQ ID NO: 336626 - DNA, 677 bp, Homo sapiens
  misc_feature: GZ8MTXP01B3FP2.51.55.E11.1.454.CMB.2.raw
  modified_base (237)..(237): a, c, t, g, unknown or other
  misc_feature (237)..(237): n is a, c, g, or t
  modified_base (287)..(287): a, c, t, g, unknown or other
  misc_feature (287)..(287): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggcaggatcacctgctgtggagatgcattcgaccaaacgntatgcttatggtaccagcagaacgccggcacgccctgtgtgtgatgtaanaaagacactgaagaggccctcgagggactccgtgacgcgatttctcctggtctaccgagggtacccgaaagggaaccgaacgggtcaaacgtagtttacgggaccctaaagtcgaggttaggaacgttcccgaagggtccgaaaggaagggaaaccgggttagggactaggtaaaccgttattaaacgtttagaactaaaacgttacgaaaacctaaggtaacccaaaccggtaatttaggttaaccttaattcggttactacggtaaacgttcggaaccgtaaaccgaagggtttaccaaccccggttcgtttacggggaccgacggacccccgaaacgggaccccaaacccctaacggttcgttaccctaaccgttttccttccccgg

SEQ ID NO: 336627 - DNA, 768 bp, Homo sapiens
  misc_feature: GZ8MTXP01CBSZT.51.55.E11.1.454.CMB.2.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgganatgcattgaccaaacgntatgcttatggtaccagcagaagccggcacggccctgtgtggtgatgtaataaagacacgtgacgacggccctgacgggtactccgtagacgtcgtacttcgtacccgtcggtctccgacgggtaccgaaaacggggacctaaccggggtctaaaccggtagtttcgggaccctagtacgaagggtcgggtacgtacccggaaggggaccgaagggtaacgggaacgggacggtacgttacggtaaccgttaatttaagtttacgggttaacctaaacgttacgaaaaccgtacgtaaaccctaacccgttaaggtttaccggtttaacgtttaaacggttcgtttaaccggtttaaccgggaaacgttcgggtaacccggtaaacccgttaacggggttacccttaaaccccggggttcccggttaacgggggttaccccgaaccggaccccccggtaaaccgggacccccctaaccccggtaacttccgggttaccccttaacccggtttcccgttttccccccggg

SEQ ID NO: 336628 - DNA, 659 bp, Homo sapiens
  misc_feature: GZ8MTXP01ADZIZ.51.55.E11.1.454.CMB.2.raw
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaacgntatgcttatgtacagcagagccggcagccctgtgtggnatgtataaagcacgtgagacggccctgagggactcccgtgacgcgtattcctcgttcggctaccgaggtcgaaacgggacaacgggtcacgtagttcgggacccatccgaggttcgggacgtcccgaagggccgaaggacgggacggtaaggccttaggaacttagttattacgttacaaagttacaaacgacgaacctaacctagttacggtaacctttaagttcgttaccgttacgggtaaaccttcgggtaaccgaaacccgttaaacggggttacccgttacccgggttacccgttacgggggttaccacccggaccccgtaaaccgggaccccaaaaccccgtccggttacgttacccgtaaccttcccgtttcccccgg

SEQ ID NO: 336629 - DNA, 639 bp, Homo sapiens
  misc_feature: GZ8MTXP01AHMPM.51.55.E11.1.454.CMB.2.raw
  modified_base (177)..(177): a, c, t, g, unknown or other
  misc_feature (177)..(177): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtntcagtgtccccaggacagacgccaggatcacctgctctggagatgcattgccaaacgntatgcttatggtaccagcagacgccggcagccctgtgtggngatagtaataaagacacgtagagacggccctagagggactcccgtgagcgtattcgtccgtcggctccgaggtcgaaagggaccaacggtcaacgtacgttcgggacctagtcgtaggtggacgtaccgaagggcgaagggtacgggaccggagggtactacggtaaccgtttaattacgtttacgtaactaaacttaccgaaactaacgaaccctaaaccttagtttaccggttatttaaacgtcgttaaccgtttacgggaaacttcggaacccgtaacgttacggtccgacccgttcggtcgggttaccacggacccgaaacggcccaaaccctcgtcgttactaaccttccgttccccg

SEQ ID NO: 336630 - DNA, 642 bp, Homo sapiens
  misc_feature: GZ8MTXP01CUFA7.51.55.E11.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (287)..(287): a, c, t, g, unknown or other
  misc_feature (287)..(287): n is a, c, g, or t
tcagcgatcgtatacacgaccggtgctcgatttagcactcgcacgttgggtttgggggggtccaggaggcagaactctgggtgtctcaccatggcctggatccctctacttctccccctctcactctctgcacaggctctgaggcctcctatgagctgacacagccaccctggtgtcagtcgtcccaggacagacggcaggatcacctgctcgtgganatgacattgaccaaacgtntatgtactttagtgtaccagcgagaacgccggacacggtccctgtgtggngatagtaataaagacacgtgagacggccctagagggactccgtagacgtcgtattccgtcgtcggtactcgaggtcgaaagggacaacggtacacgtacgttcggacctagtcgagttcggacgtaccgaagggcgaacggaagggacggaggtctagtacttagttacttagtaccaaagttacaaactaacgactaaccctagtttcgggttaacttaagttcgtaccgtttacggaacgttcggaacgtaaacccgttaggtacccttaccgttaccgtcgggttaccgacgttacccgaaacggtaccccaaacccgtcggtacgttaccctaacttcccgtttaaccccg

SEQ ID NO: 336631 - DNA, 587 bp, Homo sapiens
  misc_feature: GZ8MTXP02I3OYH.51.55.E11.1.454.CMB.2.raw
  modified_base (234)..(234): a, c, t, g, unknown or other
  misc_feature (234)..(234): n is a, c, g, or t
  modified_base (566)..(566): a, c, t, g, unknown or other
  misc_feature (566)..(566): n is a, c, g, or t
tcagcgatcgtatacacgaccggtgctcgatttagcactcgcacgttgggtttgggggtccaggaggcagaactctgggtgtctcaccatggcctggatccctctacttctcccctcctcactctctgcacaggctctgaggcctcctatgagctgacacagccacctcggtgtcagtgtccccaggacagacggccaggatcacctgctctggagatgcattgaccaaaccgntatgcttatggtaccagcagagccggcacggccctgtgtggtgatgtataaagcactgagacggccctgagggactccctggagcgattctccgtggcctccgaggtcgagggacacgggtcaacagttcggacctatcgaggtgggacgtcccgagggcgaaggaggacgaggccttaggaacttagttattaggtacctaaattccaaacgaacgaactaacccttaagtttacggttaactttagtacgttccgttaccgggtaaattcgaccgaacgtaaacggtcctaaccggtcgtcggtaccacgacccgaacggcccaaacccncgtcgtaccacttcttacccg

SEQ ID NO: 336632 - DNA, 559 bp, Homo sapiens
  misc_feature: GZ8MTXP02JDFC2.51.55.E11.1.454.CMB.2.raw
  modified_base (407)..(407): a, c, t, g, unknown or other
  misc_feature (407)..(407): n is a, c, g, or t
tcagcgatcgtatacacgaccggtgctcgatttagcactcgcacgttgggtttgggggtccaggaggcagaactctgggtgtctcaccatggcctggatccctctacttctcccctctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccagcccctgtgtggtgatgataaagacatgagaggccctcgagggatccctgagcgattcctcgtggcctccgaagggtcaacggggacaccgggtcacagttcggcccattcagtggagtccaggcgaggaggacgacgggtntagtactattagttagtacaaatacaaacgacgaacacgtagttagttacttatacgttcgttacggaacgtacgacgtaacgaacggtaccacgtccgtacggtaccaccgacccgaaccgacccaaccctactacgtcctactccgtccg

SEQ ID NO: 336633 - DNA, 540 bp, Homo sapiens
  misc_feature: GZ8MTXP02GFFU0.51.55.E11.1.454.CMB.2.raw
  modified_base (237)..(237): a, c, t, g, unknown or other
  misc_feature (237)..(237): n is a, c, g, or t
  modified_base (438)..(438): a, c, t, g, unknown or other
  misc_feature (438)..(438): n is a, c, g, or t
tcagcgatcgtatacacgaccggtgctcgatttagcactcgcacgttgggtttggggggtccaggaggcagaactctgggtgtctcaccatggcctggatccctctacttcctccccctcctcactctctgcacaggctctgaggcctcctatgagctgacacagccaccctcggtgtcagtcgtccccaggacagacgccaggatcacctgctctggagatgcattgaccaaacgntatgcttatggtaccagcagaagccggccaggcccctgtgtggtgatgtaataaagacactgagagcccctgagggactcccgtagagcgtattctccgtggcctacgaggtcgaaggggaaccaacgggtcaactagttcggcctaatcagtggacgtccaggcaggagacgaggctagactattattgtacaatacaanagacacagttgtacttatgtctcgaactgacgacgaaggtccacgtccgtggtacacgacccgaacggaccccaaacccacgtacgtaccactccttacccg

SEQ ID NO: 336634 - DNA, 514 bp, Homo sapiens
  misc_feature: GZ8MTXP02I7Q0P.51.55.E11.1.454.CMB.2.raw
  modified_base (236)..(236): a, c, t, g, unknown or other
  misc_feature (236)..(236): n is a, c, g, or t
  modified_base (328)..(328): a, c, t, g, unknown or other
  misc_feature (328)..(328): n is a, c, g, or t
  modified_base (407)..(407): a, c, t, g, unknown or other
  misc_feature (407)..(407): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagcactgagaggccctcagggatccctgagcgattcnctgctcaggtcagggacacggtcacattgccatcagtgagtccaggcagagacgaggctgactattatgtacaatcaanagacacctattggtacttatgtcttacggaactgacgaccaaaggtcaccggtcctggggtccacgcccaaacggcccaaacccctacgtcgtccacttccttcccg

SEQ ID NO: 336635 - DNA, 511 bp, Homo sapiens
  misc_feature: GZ8MTXP02FUW1C.51.55.E11.1.454.CMB.2.raw
  modified_base (236)..(236): a, c, t, g, unknown or other
  misc_feature (236)..(236): n is a, c, g, or t
  modified_base (411)..(411): a, c, t, g, unknown or other
  misc_feature (411)..(411): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgtggtgatgtataaagacactgagaggccctcagggactccctgagcgattctctggctccgaggtcagggacacggtcacattgccatcagtgagtccaggcagagacgaggctgactattattgtcaatcaanagacacctattggtacttatgtcttacggaactgacgacaaggtcacgtccgtcgggtcacgacccaaggcccaaaccccgactcgtaccactcttcccg

SEQ ID NO: 336636 - DNA, 583 bp, Homo sapiens
  misc_feature: GZ8MTXP02HNI5S.51.55.E11.1.454.CMB.2.raw
  modified_base (415)..(415): a, c, t, g, unknown or other
  misc_feature (415)..(415): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagagccggcaggcccctgtgtggtgatgtataaagacactgagaggccctgagggatccctgagcgattctcctggctcaggtcagggacacggtcatattgccatcagtggatccgaggcagaggacgagggctagactattacttgtacaaattcaaanagaaccaaccagtttacggtaactttagtgttacctttacggaacttcggaccgtaaaccgtaaagggttcccaaacccggttcccgttacgggggtacccaacggaccccgaaaacgggcccccaaaacccccgtactacggtaccctaacctttccgtttaccccg

SEQ ID NO: 336637 - DNA, 570 bp, Homo sapiens
  misc_feature: GZ8MTXP02JF4KQ.51.55.E11.1.454.CMB.2.raw
  modified_base (238)..(238): a, c, t, g, unknown or other
  misc_feature (238)..(238): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttatgtacagcagagccggcacgccctgtgtgtgatgtataaagacactgagacggccgtcgagggactccgtgacgcgattctccgtgctccgaggtacgaggaacgacggtacacagttgaccagggggtacaggtaggacgtacgacggacgaaggaagggacggaggacgtagtactattaagttgtactaaatacaacacgacaacctagttagtacttatgttcgttacgtaacgtacgaccgtaccgaacgtaccgtaccgtccgtcggtaccgaccgacccgaaccggacccaacccgactcgtacctacctcgtcccg

SEQ ID NO: 336638 - DNA, 508 bp, Homo sapiens
  misc_feature: GZ8MTXP02GDJJH.51.55.E11.1.454.CMB.2.raw
  modified_base (408)..(408): a, c, t, g, unknown or other
  misc_feature (408)..(408): n is a, c, g, or t
tcagcgatcgtatacacgaccggtgctcgatttagcactcgcacgttgggtttgggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgtggtgatgtataaagacactgagaggccctcgagggactcccgtgagcgattctcctggctcaggtcagggacacggtcacattgccatcagtgagtccgagcagagacgaggctgactattatgcaatcaanagacacattggtacttatgtcttacggaactgacgacgaaggtccaccgtcctgggtaccacgacccaaggcccaaaccctactcgtaccacttctcccg

SEQ ID NO: 336639 - DNA, 552 bp, Homo sapiens
  misc_feature: GZ8MTXP02IUNWC.51.55.E11.1.454.CMB.2.raw
  modified_base (237)..(237): a, c, t, g, unknown or other
  misc_feature (237)..(237): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaaccgntatgcttattggtaccagcagaagccggcaggccctgtgtggtgatgtataaagacactgagacggcctcgagggactcccgtgagcgattctctggctcgaggtcgagggacacgggtcacagttcggccatacgagtggagtccaggcaggaggacgacggctgaacttattattgtacaatacaacagacacctagttcggtacttagtcgttcgttacgactcgtacgacctaagggtccaaccggttccgtcggggtaccacgtacccgaaacggccccaaacccgtactcgtacctctaccgtttcccg

SEQ ID NO: 336640 - DNA, 542 bp, Homo sapiens
  misc_feature: GZ8MTXP02H1WCW.51.55.E11.1.454.CMB.2.raw
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaaggccgggccacggcccctgtgtggtgatgtaataaagacatgagagccctcgagggactcccngagcgattctctcggctccnggtacgagggacacgggtcacagttcggcccatcgagtaggtagcccgaggcgaaggagggacggaggctagacttattagttgtacaaatacaanagacactagttgtacttatgtcttacgactcgtacgaccgaggtctaccgtacctcgggactcgacccgaacgacccaaccccgctacgtctacctcttccg

SEQ ID NO: 336641 - DNA, 535 bp, Homo sapiens
  misc_feature: GZ8MTXP02JSNWI.51.55.E11.1.454.CMB.2.raw
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacactgagaggcccctcgagggactcccgtgagcgattctcctggctcgaggtcagggacacggtcacattgccatcagtggagtccgaggcaggaggacgaggctagacttagttattgtacaatcaacagaccactattaggtacttatgtacttcggaactgaccgacgaaggtccaccggtcgtcgggtaccacgaccccgaacggaccccaaacccgctacgtcctactcttcccg

SEQ ID NO: 336642 - DNA, 546 bp, Homo sapiens
  misc_feature: GZ8MTXP02IGM3F.51.55.E11.1.454.CMB.2.raw
  modified_base (320)..(320): a, c, t, g, unknown or other
  misc_feature (320)..(320): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgtggtgatgtataaagacactgagaggccctcgagggatcccngagcgtattctcctggctccaggtcaggggacacggtcacattcgccagtcagtggagtccaggcaggaggacgaggctgactattattgtacaaatcaacagacacctattaggtactttatgttcttcggaaactcgacgaacccgaaggtccaccgtccgttcgggtacctacggaccccaaaggaccccctaacccgactacgtcctacctccgtttacccg

SEQ ID NO: 336643 - DNA, 682 bp, Homo sapiens
  misc_feature: GZ8MTXP02G1IRB.51.55.E11.1.454.CMB.2.raw
  modified_base (176)..(176): a, c, t, g, unknown or other
  misc_feature (176)..(176): n is a, c, g, or t
  modified_base (236)..(236): a, c, t, g, unknown or other
  misc_feature (236)..(236): n is a, c, g, or t
  modified_base (279)..(280): a, c, t, g, unknown or other
  misc_feature (279)..(280): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctggagatgcattgaccaaacgntatgcttattggtaccagcagagccggcacggccctgtgtgtnntgtataaagacacgtgagacggccctagagggactcccgtagagtcgtattctaccgtcggccttccgaggtaccgaggggaaccaccgggttcaactagttcggacctagtccgaggtcggacgtcccgaggccgaaggagggacgtaacggtctacggtaacttagtttacgttaggttaactaaacgtactaaaccgaacggtaacctaaaccccgtaagttttacgggttaaacctttacgttacggttaccgttaacggtaaacgttacggaaccggtaaacccggtaaaggtccccgtaaccggttcccggttacgggtacccgacggtaacccccgaaaggtaccccccaaacccccggtaacttccggtaccctaaccttccgtttaacccccg

SEQ ID NO: 336644 - DNA, 670 bp, Homo sapiens
  misc_feature: GZ8MTXP02GHPZ5.51.55.E11.1.454.CMB.2.raw
  modified_base (236)..(236): a, c, t, g, unknown or other
  misc_feature (236)..(236): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctggtgtcagtcgtcccaggacagacggcaggatcacctgctctggagatgcattgaccaaacgtntatgcttatgtaccagcagagccggcacggccctgtgtggtgatgtaataaagcactgagacggcctcgagggactcccgtgagcgtattctccgtggcctcgacggtcgaaggacacgggtcaactcgttgcctagtcgagtggacgtcccgaggacgaggaacggacggacgggtactaggaacttaagttagtttacgaactaaacttaacaaaacgtaacggaaacctaacgttaaacgtttacgggttaaactttagttacgtttaccggttaaaccgggtaaccgttacggaacccgtaaaacccgtaaaccgggttcccgaaaccccgggtttccgtacgggggtacccaacggtaacccccgtaaaacgggacccccaaaacccccgtacgttaccgtacccgtaaccctttccgtttacccccgg

SEQ ID NO: 336645 - DNA, 640 bp, Homo sapiens
  misc_feature: GZ8MTXP02G6N9W.51.55.E11.1.454.CMB.2.raw
  modified_base (241)..(241): a, c, t, g, unknown or other
  misc_feature (241)..(241): n is a, c, g, or t
  modified_base (490)..(490): a, c, t, g, unknown or other
  misc_feature (490)..(490): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtggagatgctattcgaccaaacgntatgcttatggtaccagcaagaacggccggccacggtccccgtgtggttggtgatagtaataaagactacgtagaaggacggcccctagagggactcccgtgacgtcgtattctccgtcgtctccgaggtacgaacgggaacaccgggtcaacgtaacgttcggaccctagtcgtaggtacggacgtacccgaggaccgaaggaagggacgtagggctacggtaatagttattagtactaaatacaaanacgtaacaacctagttacggttacttagtacgttacgttacggaacttcgacgtaaaccgtaggtcccgtaccggttacgttcgggaccaccggacccgaaaccggaccctaaaccccgtacgttccgtacctacctcgtttaacccccg

SEQ ID NO: 336646 - DNA, 557 bp, Homo sapiens
  misc_feature: GZ8MTXP02GVX4Y.51.55.E11.1.454.CMB.2.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (413)..(413): a, c, t, g, unknown or other
  misc_feature (413)..(413): n is a, c, g, or t
tcagcgatcgtatacacgaccggtgctcgatttagcactcgcacgttgggtttggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgctattgaccaaacgntatgcttatggtaccagcagaagccggcaggccctgtgtggtgatgataaagacactgagacggccctagagggactcccgtgagcgattctccgtgctccaggtcgagggacacggtcacagttcgctatcgagtgagtccgaggacaggagacgagcagactagttattagtanaatacaacgagtaccaacctagttaggtaactttatgttcgttacggtaacttcgacgaccgaaggttccacccggtaccgtcgggtaccacgaaccccgaaacggtccccaaacccgtactacgtaccaaccttccgttaccc

SEQ ID NO: 336647 - DNA, 564 bp, Homo sapiens
  misc_feature: GZ8MTXP02GOUPG.51.55.E11.1.454.CMB.2.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaacgccggccaggcccctgtgtgtgatgtaataaagacactgagacggccctagagggactcccgtgagcgtattcncctagccncaggtacagggacacgggtcacattggcctancagtgagtcagcagagacgagcngactattattgacaatacaaacagacaactagtttacgtaactttagtacggttacttacggtaaaatcggtaccgaaccgtaaaggttccaaacccgttcgttacgggaccacgacccgaaacggcccctaaaccccacgtacgtaccaaccgttcgttccccg

SEQ ID NO: 336648 - DNA, 643 bp, Homo sapiens
  misc_feature: GZ8MTXP02JFJW8.51.55.E11.1.454.CMB.2.raw
  modified_base (220)..(220): a, c, t, g, unknown or other
  misc_feature (220)..(220): n is a, c, g, or t
  modified_base (530)..(530): a, c, t, g, unknown or other
  misc_feature (530)..(530): n is a, c, g, or t
tcagcgatcgtatacacgaccggtgctcgatttagcactcgcacgttgggtttgggggggtccaggaggcagaactctgggtgtctcaccatggcctggatccctctacttctccccctctcactctctgcacaggctctgaggcctctatgagctgacacagcccaccctcggtgtcagtcgtccccaggacagacggccaggatcactgctcgtggantgcattcgacccaaacgatatgtactttagtacggtaccagcgagaacggccggaccacggccccgtggtcggttggtagtaagtaggtaaataaacgaccgtacgtggaacggaccggtccctaggacgggactcccgtaggacgcgtacttccgtccgtcggacctcccggaggtacgaacggggaacctaccgggtacaacgtacgttcgggaccctaagttccggaaggtacgggtaccgtaccgacgggacgaaggtaaccggacgaggtaccgtagtaccgtttagtacttagactaatacaanacgtactaacgtagtttacgtacttacgtcgttacgtacgaacgtgaccgtacgtaacgcctacgtcgtcgtacacggaccaacggaccccacctgtcacgtcttacgtcccg

SEQ ID NO: 336649 - DNA, 844 bp, Homo sapiens
  misc_feature: GZ8MTXP02GM9O3.51.55.E11.1.454.CMB.2.raw
  modified_base (176)..(176): a, c, t, g, unknown or other
  misc_feature (176)..(176): n is a, c, g, or t
tcagcgatcgtatacacgaccggtgctcgatttagcactcgcacgttgggtttgggggggtccaggaggcagaactctgggtgtctcaccatggcctggatccctctacttctccccctcctcactctctgcacaggctctgaggcctcctatgagctgacacagccaccctggtntcagtcgtccccaggacagacggccaggactcactgctcgtggagatgctagttcgaacctaaaccgtatatgtacttagttacgtaccagacgaagaacggcccggccgacgggtccccttggtggttggtagtagtagttaaataaacgactaccgtaggacgacggtacccgtacggacgggtactaccccgtaggtacgaccgttactttccgtccccggttcggtacccgtaccggaacgggttacccggaaacggggaacgttaaacccggggtcctaaacggttacgtttacggggaaccctacgttaccgggtaaaggttacggggaccgtacccggaaggggtaaccgaaaggggaaacggggtaaccggtagggtaccgttaaggttaaactttaatttaacgggtttacgtaaacgtaaacttaaaccgaaaacggtaccgtaaaccgttaaccttaaacggtttacgttaaccggttttagtaacggtttacccggttaacgttaaccgacggtaccgtaaaccggtaaaccggttcctaaacccgggttcggttacccggtaaccgtacccggtaaaccccgaaaaccgggttacccccccgaaaaaccccttcggtaacccggttacccctactttaccccgtttccccccggg

SEQ ID NO: 336650 - DNA, 525 bp, Homo sapiens
  misc_feature: GZ8MTXP01DG1SB.22.30.C08.1.454.CMB.2.raw
  modified_base (280)..(280): a, c, t, g, unknown or other
  misc_feature (280)..(280): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
tcagacatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccatttggcagccacacaaggggtcggatccctgatcgcttctcgggctccagctcgtcggggccgagcgctaccctcaccntctccagccctccagtctgaagntgaggctgactattactgtcagacatgggacgcgtggcgtctgggctgttcggcggagggaccaagctgaccgtctaggcagcccgaaggcttcgccccttggtcactctcgtcccgccctccgttcgccg

SEQ ID NO: 336651 - DNA, 524 bp, Homo sapiens
  misc_feature: GZ8MTXP01D9ZMK.22.30.C08.1.454.CMB.2.raw
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccatttggcagccaccacaagggggtcgggatccctgatcgcttctcgggctccagctctggggccgagcgctacctcaccntctccagcctccagtctgaagatgaggctgactattactgtcagacatgggacgcgtggcgtctgggctggttacggcggagggccaagctgaccgtctaggttcagcccaagggcttcgccccttggtcactctgtcccacctcttcaacg

SEQ ID NO: 336652 - DNA, 528 bp, Homo sapiens
  misc_feature: GZ8MTXP01A9RLM.22.30.C08.1.454.CMB.2.raw
  modified_base (365)..(365): a, c, t, g, unknown or other
  misc_feature (365)..(365): n is a, c, g, or t
tcagacatacgcgtcacgaccggtgctcgatttagtctgacgtcaaagggaaagggagagctctggggagtctgcaccatggcttgcaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaagggccctcgctactaatgaagattggccatttggcagccacacaagggggtcggatccctgatcgcttctcggctccagctccgtggggcagcgctaacctcnccatctccagcctccagtctgagatgaggctgactattactgcagacagtgggacgctggccgtctggctggttcggcggagggaccaagctgaaccgtcgttagggtcagcccaaggccttcgccccctggtccaacgtcctcgttccccgcccttctcccg

SEQ ID NO: 336653 - DNA, 530 bp, Homo sapiens
  misc_feature: GZ8MTXP01EIJHL.22.30.C08.1.454.CMB.2.raw
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtggcatcaaacaacagccggagaagggccctcgctactaangaagattggccatttggcagccacacgaaggggtcggatccctgatcgcttctcgggctccagctcgtcggggccgagcgctacctcaccntctccagcctccagtctgaagatgagctgactattactgtcagacatgggacgcgtggcgtctggctggttcggcggagggaccaaggctgaccgtcctaggttcagcccgaaggccttcgccccttggtcactctcgttcccccncctccncgcg

SEQ ID NO: 336654 - DNA, 521 bp, Homo sapiens
  misc_feature: GZ8MTXP01DM9WI.22.30.C08.1.454.CMB.2.raw
  modified_base (280)..(280): a, c, t, g, unknown or other
  misc_feature (280)..(280): n is a, c, g, or t
  modified_base (371)..(371): a, c, t, g, unknown or other
  misc_feature (371)..(371): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (496)..(496): a, c, t, g, unknown or other
  misc_feature (496)..(496): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctgctactaangaagattggccatttggcagccaccacgaagggggtcggatccctgatcgcttctcgggctccagctcgtcggggccagcgctacctcacntctccagcctccagtctagaagatgaggctgactattacngtcagacagtggacncgtggngtcnggctgtcggcggagggccaagctgccgtctggcagcccaaagggcttcgccccttggccnctctcgtcccgccctcttcgaaccg

SEQ ID NO: 336655 - DNA, 533 bp, Homo sapiens
  misc_feature: GZ8MTXP01D3VT4.22.30.C08.1.454.CMB.2.raw
  modified_base (280)..(280): a, c, t, g, unknown or other
  misc_feature (280)..(280): n is a, c, g, or t
  modified_base (529)..(529): a, c, t, g, unknown or other
  misc_feature (529)..(529): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgactgactcaatcgccctctgcctctgcctccctgggagcctcggtcaacctcacctgcgttcttagtagtcaacacgattactacaccgtcgcgtggcatcaacaacagccggagaaggccctcgctacttaangaagattggcctattttggcagccaccacgaagggggtcgggatccctgatcgcttctcgggctccagctcgtgggggccagcgcctacctcaccaatctcccagccctcagtctgagatgaggctgactattactgtcagacagtgggacgcgtgggcgtctgggctgttcgggcggagggccaagctcgaccgtctagggcacgccgaaggcttcgcccccttggtcactctgtccccacctccttnaacg

SEQ ID NO: 336656 - DNA, 539 bp, Homo sapiens
  misc_feature: GZ8MTXP01ENMD4.22.30.C08.1.454.CMB.2.raw
  modified_base (282)..(282): a, c, t, g, unknown or other
  misc_feature (282)..(282): n is a, c, g, or t
  modified_base (371)..(371): a, c, t, g, unknown or other
  misc_feature (371)..(371): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccatttggcagccacacaaggggtcggatccctgatcgcttctcgggctccagctctcggggccgagcgctacctcaccntctccacgcctccagtctgaagatgaggctgactattactgtcagacatgggacgcgtggcgtctgggctggttcggcggaggggaccctaaggctcggacccgtcctaggttcacgcccgaaaggcttcgccccttggtccactctcgtcccacctccttcgaaccg

SEQ ID NO: 336657 - DNA, 559 bp, Homo sapiens
  misc_feature: GZ8MTXP01B9IN6.22.30.C08.1.454.CMB.2.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccattttggcagccaccacgaagggggtcggatccctgatcgcttcgtcgggctccagctcgtcggggccgagcgctacctcaccntctccagccctcagtctgaagntgaggctagactattactgtcagacagtgggacgcgtggcgtcgtggctggttcgggcggaacgggaccaaggctcggaccgtccgtaaggttcacggcccgaagggccttcgcccccgttcggtccaccgtctccgtccccacccgtccttccgtaaccg

SEQ ID NO: 336658 - DNA, 533 bp, Homo sapiens
  misc_feature: GZ8MTXP01EP3A2.22.30.C08.1.454.CMB.2.raw
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccatttggcagccaccacgaaggggtcggatccctgatcgcttctcgggctccagctctggggccgagcgctaccctcaccntctccagccctcagtctganatgagctgactattactgtcagtacatgggacgcgtgggcgtctgggctggttcggcggagggaccaagctcgccgtctaaggttcacgccgaaggccttcgccccgttggtccactctcgtccccacctccttcaaccg

SEQ ID NO: 336659 - DNA, 654 bp, Homo sapiens
  misc_feature: GZ8MTXP01ENVWR.22.30.C08.1.454.CMB.2.raw
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaaacaacagccggagaaggccctgctacttaangaagattggctatttggcagccaccacgaagggggtcggactccctgactcgcttcgtcgggctccgagctcgtcggggccgagcgctacctcaccntctccacgccctaccagtctagaagatggaggctagacttattactgtacagacagtacgggacgcggtgggcgttcgtgggcgttcgggttccgggacgggaaacggggtacccaaagggtccgttacggaaccccggttccgtaaagggttcccgaaccggaccccgaaacgggtccccgttcccgggttcccccccgttaccggggttccctaacccgtttcccgttcccggtttaccccccgttaaccccttcccgtttcccgtaaccccggg

SEQ ID NO: 336660 - DNA, 586 bp, Homo sapiens
  misc_feature: GZ8MTXP01DO51N.22.30.C08.1.454.CMB.2.raw
  modified_base (278)..(278): a, c, t, g, unknown or other
  misc_feature (278)..(278): n is a, c, g, or t
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaggccctgctactaangaagatgccatttgcagcacacgaaggggtcggatccctgatcgcttcgtcgggctccagctcgtcggggccgagcgctacctccaccntctccagccctccagtctgaagntgaggctgactaattactgtcagacagtgggacgcgtcggcgttcgtgggtcgtggttcgggcgggaacgggacccgaaggtcgtacggacccgttccgtagggttccacggaccccgaaagggtccgttaccggcccccgttcgggtccctacttccgttccggtcccccttaccccttcccttccgtaacccgg

SEQ ID NO: 336661 - DNA, 534 bp, Homo sapiens
  misc_feature: GZ8MTXP01B6225.22.30.C08.1.454.CMB.2.raw
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaagggccctcgctacttaatgaagattggccattttggcagccaccacaaggggtcggatccctgatcgcttctcgggctccagctctcggggccagcgctacctcaccntctccagcctccagtctgaanatgaggctgactattactgtcagacatgggacgcgtggcgtctgggctggttcggcggtagggccaagctggaccgtcctaggttcagcccgaaagggccttcgccccttcggtcacgtctcgttccccacctccttcgccg

SEQ ID NO: 336662 - DNA, 534 bp, Homo sapiens
  misc_feature: GZ8MTXP01CT5L3.22.30.C08.1.454.CMB.2.raw
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
  modified_base (529)..(529): a, c, t, g, unknown or other
  misc_feature (529)..(529): n is a, c, g, or t
tcagacatacgcgtcacgaccggtgctcgatttagtctgacgtcaaagggaaagggagagctctggggagtctgcaccatggattggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccatttggcagccaccacgaagggggtcggatcccctgatcgcttctcgggctccagctcgtcggggccgagcgctacctcacntctccagccctccagtctagaanatgaggctgaactattactgtacagacatgggacgcgtggcgtctggctggtcggcggaagggacccaaagtgaccgtctaaggtcagcccaagctcgcccccgttgcaactcgtcgttccccacccttctcncgtcg

SEQ ID NO: 336663 - DNA, 551 bp, Homo sapiens
  misc_feature: GZ8MTXP01DTE8P.22.30.C08.1.454.CMB.2.raw
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (519)..(519): a, c, t, g, unknown or other
  misc_feature (519)..(519): n is a, c, g, or t
  modified_base (534)..(534): a, c, t, g, unknown or other
  misc_feature (534)..(534): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccatttggcagccacacgaagggggtcggatcccctgatcgcttctcgggctcagctcgtcggggccagcgctacctcaccntctcagcctcagtctgaagatgagntgactattactgtcagacagtgggacncgtggcgtctggctggttcggcggaagggacctaagctcggaccgtcctaaggttccaacgcccgaaagggtccttcggccccccttggtaaccncgttctcggtccccnccctccttcgaacccgg

SEQ ID NO: 336664 - DNA, 574 bp, Homo sapiens
  misc_feature: GZ8MTXP01EH9E5.22.30.C08.1.454.CMB.2.raw
  modified_base (279)..(279): a, c, t, g, unknown or other
  misc_feature (279)..(279): n is a, c, g, or t
  modified_base (368)..(368): a, c, t, g, unknown or other
  misc_feature (368)..(368): n is a, c, g, or t
  modified_base (531)..(531): a, c, t, g, unknown or other
  misc_feature (531)..(531): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacacgtcgcgtgcatcaacaacagccggagaagggccctcgctactaangaagattggcatttggcagccacacgaaggggtcggatcctgatcgcttctcgggctccagctcgtcggggccgagcgctacctcaccntctccagcctccagtctgaagatggaggctgacttattactgtcagacagtgggacgcgtggcgttctgggctcggttcgggcgggaagggaccaaggcctacggcccggtccgtaggttccacggcccgaaagggtccttcggcccccgttcgggtaacccnccgttccgttccggttcccccgccccttcccttccgaacccgg

SEQ ID NO: 336665 - DNA, 528 bp, Homo sapiens
  misc_feature: GZ8MTXP01AS98O.22.30.C08.1.454.CMB.2.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtgcgtgcatcaacaacagccggagaaggccctcgctacttaangaagattggccatttggcagccacacgaagggggtcggatcccgtgatcgcttcgtcgggctccagctcgtcggggccagcgctacctcaccntctccagccctccagtctgaagatgaggctgactattactgtcagacagtgggacgcgtgggcgtctggctggtcgggcggagggaccaagctcgaccgtccaggttcacgcccgaaggcnccgccccgttgcncgtctcgtcccgcctcttcgcg

SEQ ID NO: 336666 - DNA, 523 bp, Homo sapiens
  misc_feature: GZ8MTXP01EMX03.22.30.C08.1.454.CMB.2.raw
  modified_base (279)..(279): a, c, t, g, unknown or other
  misc_feature (279)..(279): n is a, c, g, or t
  modified_base (374)..(374): a, c, t, g, unknown or other
  misc_feature (374)..(374): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacaacagccggagaaggccctcgctactaangaagattggccatttggcagccaccacgaagggggtcggatcccgtgatcgcttcgtcgggctccagctcgtcggggccgagcgctacctcaccntcctccagccctccagtctgaagatgaggctgacttattactgtcagacatgggacncgtggcgtctggctgtcggnggagggccaagctgcgtctaggttcagcccaaggcttcgccccttggtcactctcgtcccacctcttcaacg

SEQ ID NO: 336667 - DNA, 591 bp, Homo sapiens
  misc_feature: GZ8MTXP01EUXZR.22.30.C08.1.454.CMB.2.raw
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaangaagattggctatttggcagccaccacgaaagggggtcgggatcccgtgatcgcttcgtcgggctccgagctcgtcgggccgagcgctacctcaccntctcacgtcctccagtctagaagatgaggctagactagtactgtacagacagtgggacgcggtgggtcgtcgtgggtcgtggttccgggcgggtagggacccaaaggtctcggaacccggtcgtaacgggttcgacggcccgaacggtccgttcccggcccccgttcgggtccaccttccgttccggttccccgccccttcccttccgtcccgg

SEQ ID NO: 336668 - DNA, 523 bp, Homo sapiens
  misc_feature: GZ8MTXP01D0XP1.22.30.C08.1.454.CMB.2.raw
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagcccggagaagggccctcgctactaangaagattggccatttggcagccaccacgaagggggtcggatccctgatcgcttctcgggctccagctctcggggccagcgctacctcaccntctccagcctccagtctgaagatgagctgactatactgtcagacagtgggacgcgtggcgtctgggctgttcggcggagggccaagctgccgtctaggttcacgccaaggcttcgcccccttggtccactctcgtcccgcctccgctccg

SEQ ID NO: 336669 - DNA, 539 bp, Homo sapiens
  misc_feature: GZ8MTXP01DV5SX.22.30.C08.1.454.CMB.2.raw
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctatctcccaggttgtactgactcaatcgccctctgcctctgcctccctgggagcctcggtcaacctcacctgcgttcttagtagtcaacacgattacacaccgtcgcgtggcatcaacaacagccggagaagggccctcgctactaangaagattggccatttggcagccaccacgaagggggtcggatccctgatcgcttctcgggctccagctcgtcggggccagcgctaccctcaccntctccagcctccagtctgaagntgaggctgactattactgtcagacagtgggacgcgtggcgtctgggctggttcgggcggtagggccaagctcggaccgtcgtaaggcacggcccgaaagggcttcgccccttggtcactctcgtccccaccgtccttcgaaccg

SEQ ID NO: 336670 - DNA, 527 bp, Homo sapiens
  misc_feature: GZ8MTXP01DCI37.22.30.C08.1.454.CMB.2.raw
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccattttggcagccaccgacaagggggtcggatccctgatcgcttcncgggctccagctcgtcggggccgagcgctacctcaccntctccagcctcagtcngaagatgagctgactattactgtcagacatgggacgcgtggcgtctgggctggttcggcggagggccaagctgccgtctaggttcagccaaggcttcgccccttggtcacgtctcgtcccacctccttcgaaccg

SEQ ID NO: 336671 - DNA, 570 bp, Homo sapiens
  misc_feature: GZ8MTXP01E3R2Z.22.30.C08.1.454.CMB.2.raw
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaagggccctcggctacttaatgaaagattggccattttggcagccaccacgaaggggtcgggatccctgatcgcttctcgggctccagctcgtcgggggccgagcgctacctcaccaatctccagcctccagtctcgaagatggaggctagacttatactgtcagacagtgggacgcgtgggcgtcgtggcttggttcgggcggacgggaccaaggcgtacgacccgtcgttacggccgacggcccgaaacgggcttcggcccccttggggtccactccgtcgttccccgccctccgcgtaacccgg

SEQ ID NO: 336672 - DNA, 568 bp, Homo sapiens
  misc_feature: GZ8MTXP01EC230.22.30.C08.1.454.CMB.2.raw
  modified_base (185)..(185): a, c, t, g, unknown or other
  misc_feature (185)..(185): n is a, c, g, or t
  modified_base (278)..(278): a, c, t, g, unknown or other
  misc_feature (278)..(278): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtgcatcaacaacagccggagaaggccctgctactaangaagattggccatttggcagccacacgaagggggtcgggatcccgtgatcgcttcgtcgggctccagctcgtcggggccgagcgctacctcaccntctccacgccctcagtctagagatgagctagacttatactgtacagacagtgggacncggtggcgtcgtcggtcgtggtcggcgggtaacggaccgtaagccgtcggaccgttccgtaggttcgacgcccgaacggtccttccggcccccttgggtcccaccgtcgtacccgttccccacctcccttcgaacccg

SEQ ID NO: 336673 - DNA, 551 bp, Homo sapiens
  misc_feature: GZ8MTXP01DSOX6.22.30.C08.1.454.CMB.2.raw
  modified_base (185)..(185): a, c, t, g, unknown or other
  misc_feature (185)..(185): n is a, c, g, or t
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaagggccctcgctacttaangaagattggccatttggcagccaccacgaagggggtcggatccctgatcgctttcncgggctccagctcgtcggggccagcgctacctcaccntctccagccctccagtctgaagatgaggctgactattactgtcagacagtgggacgcgtggcgttctgggctggttcgggcggaagggtccaaggctggaacccgtctaacggttcacggcccgaagggcttcggcccccttggtccactcctcgtccccacctccttcgtaaccg

SEQ ID NO: 336674 - DNA, 533 bp, Homo sapiens
  misc_feature: GZ8MTXP01EGJ3I.22.30.C08.1.454.CMB.2.raw
  modified_base (279)..(279): a, c, t, g, unknown or other
  misc_feature (279)..(279): n is a, c, g, or t
  modified_base (370)..(370): a, c, t, g, unknown or other
  misc_feature (370)..(370): n is a, c, g, or t
tcagacatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaangaagattggccatttggcagccacacgaagggggtcggatccctgatcgcttctcgggctcagctcgtcggggccgagcgctacctcaccntctccagcctccagtctgaagatgaggctagacttatactgtcagacagtgggacgcgtggcgtcgtggctggttcggcggagggaccaagcgtgaccgtctaggttcacgcccgaaaggccttcgccccttggtccactctcgtcccgccctccgctaaccg

SEQ ID NO: 336675 - DNA, 544 bp, Homo sapiens
  misc_feature: GZ8MTXP01CXSMU.22.30.C08.1.454.CMB.2.raw
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaangaagattggccattttggcagccaccacgaagggggtcgggatcccctgatcgcttcncgggctccagctcgtcggggccgagcgctacctcaccntctccagcctccagtctgaagatgaggctgactattactgtcagacatgggacgcgtgggcgtctgggcttggttcggcgggtacgggaccaaggctggacccgtccgtaaggttcacgcccgaaaggcttcgccccttggtcactctcgtcccgcctcttcgaaccg

SEQ ID NO: 336676 - DNA, 547 bp, Homo sapiens
  misc_feature: GZ8MTXP01CMSBV.22.30.C08.1.454.CMB.2.raw
  modified_base (185)..(185): a, c, t, g, unknown or other
  misc_feature (185)..(185): n is a, c, g, or t
  modified_base (280)..(280): a, c, t, g, unknown or other
  misc_feature (280)..(280): n is a, c, g, or t
  modified_base (374)..(374): a, c, t, g, unknown or other
  misc_feature (374)..(374): n is a, c, g, or t
  modified_base (440)..(440): a, c, t, g, unknown or other
  misc_feature (440)..(440): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaagggccctgctactaangaagattggccattttggcagccaccacgaaggggtcggatcccctgatcgcttctcgggctccagctcgtcggggccgagcgctacctcaccntctccagcctcagtctgaagatggaggctgactactactgtcagacagtgggacgcgtggcgtcgnggctggttcggcgggacgggaccaagctcggccgtcgtaggttcacgcccgaaagggccttcggcccccttcggtcacctcgtcgttccccaccctccttcgaaccg

SEQ ID NO: 336677 - DNA, 569 bp, Homo sapiens
  misc_feature: GZ8MTXP01DK4HK.22.30.C08.1.454.CMB.2.raw
  modified_base (336)..(336): a, c, t, g, unknown or other
  misc_feature (336)..(336): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattacacaccgtcgcgtggcatcaacaacagccggagaagggccctcgctactaatgaagattggccattttggcagccaccacaagggggtcggatcccctgatcgcttcncgggctccagctcgtcggggccgagcgctacctcaccntctccagcctccagtctgagntgaggctgactattactgtcagacagtgggacgcgtgggcgttcgtcgggtcttggttcggggcgggtaacggggaccgtaaagccgtcggacccgttccgtaagggttcacggcccgaagggccttcggcccccttaggtccaccttctcgttccccgccttccgcgtaaccg

SEQ ID NO: 336678 - DNA, 562 bp, Homo sapiens
  misc_feature: GZ8MTXP01AYP2Z.22.30.C08.1.454.CMB.2.raw
  modified_base (260)..(260): a, c, t, g, unknown or other
  misc_feature (260)..(260): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaaggggagagctctggggagtctgcaccatggcttggaccccactcctcttcctcaccctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccgganaagggcctcgctactatgaagattggccatttggcagccaccgacgaagggggtcggatccctgatcgcttcgtcgggctcgagctcgtggggccccgagcgctaccctcaaccatctccacgccctccagtctagaacgatgagctgactattacgngtcagacagtgggacncgtgggggcgtcgtgggcttggttcgggcggaggtaccaagtccgtcggtacccgtcgtaaggtccaaggccccaagggcctcgcccccgttgttccaactcgtccgtcccaccttcctcgaacgtcg

SEQ ID NO: 336679 - DNA, 546 bp, Homo sapiens
  misc_feature: GZ8MTXP01B8F8E.22.30.C08.1.454.CMB.2.raw
  modified_base (282)..(282): a, c, t, g, unknown or other
  misc_feature (282)..(282): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (517)..(517): a, c, t, g, unknown or other
  misc_feature (517)..(517): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccatttggcagccaccacgaaggggtcggatccctgatcgcttctcgggctccagctcgtcggggccgagcgctacccgtcacccntcctccacgcctccagtctcganatgaggctgactattactgtcagacatgggacgcgtgggcgtctggctggttcgggcggagggacctaagctcggaccgtcgtaggttcacgccgaaggcttcggccccttcggtcnctcctcgttcccaccctccttcgtaaccg

SEQ ID NO: 336680 - DNA, 535 bp, Homo sapiens
  misc_feature: GZ8MTXP01D565W.22.30.C08.1.454.CMB.2.raw
  modified_base (281)..(281): a, c, t, g, unknown or other
  misc_feature (281)..(281): n is a, c, g, or t
  modified_base (377)..(377): a, c, t, g, unknown or other
  misc_feature (377)..(377): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaangaagattggccattttggcagccaccacgaagggggtcggatcccctgactcgcttctcgggctccagctcgtcggggccgagcgctacctcaccntctccacgcctccagtctgaagatgagctgactattactgtcagacagtgggacgcgtggcgtctggcgtgttcggcggacggccaagctcgccgtcgtgttcacgccgaaggcttcgccccttcggtcactccgtcgtcccgccctccttctaaccg

SEQ ID NO: 336681 - DNA, 541 bp, Homo sapiens
  misc_feature: GZ8MTXP01AWDGU.22.30.C08.1.454.CMB.2.raw
  modified_base (185)..(185): a, c, t, g, unknown or other
  misc_feature (185)..(185): n is a, c, g, or t
  modified_base (281)..(281): a, c, t, g, unknown or other
  misc_feature (281)..(281): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (430)..(430): a, c, t, g, unknown or other
  misc_feature (430)..(430): n is a, c, g, or t
  modified_base (515)..(515): a, c, t, g, unknown or other
  misc_feature (515)..(515): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaagggccctcgctactaangaagattggccattttggcagccacacgaaggggtcggatccctgatcgcttcgtcgggctccgagctcgtcggggccagcgctacctcaccntctccagcctcagtctagaagntgaggctgactattactgtacagacagtgggacncggtggcgtcgtggtcgtggttcggcggagggaccaagcgtcgaccgtcgtggttcacgcccgaaggcttccgccccttggtccncgtctcgtcccgccctcttcgaaccg

SEQ ID NO: 336682 - DNA, 543 bp, Homo sapiens
  misc_feature: GZ8MTXP01D630H.22.30.C08.1.454.CMB.2.raw
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
  modified_base (375)..(375): a, c, t, g, unknown or other
  misc_feature (375)..(375): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtggcatcaacaacagccggagaaggccctcgctactaangaagattggccatttggcagccaccacgaagggggtcggatccctgatcgcttcncgggctccagctcgtcggggccgagcgcctacctcaccntctccagccctccagtctagaagatggaggctgactagttactgtcagacagtgggacgcgtgggcgtcgtggtctggttcgggcggaagggaccaagcgtgccgtcgtaggcacgcccgaagggtcttccgccccttggtcactctcgtcccaccctccttcaaccg

SEQ ID NO: 336683 - DNA, 620 bp, Homo sapiens
  misc_feature: GZ8MTXP01DIG98.22.30.C08.1.454.CMB.2.raw
  modified_base (440)..(440): a, c, t, g, unknown or other
  misc_feature (440)..(440): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgtattacacaccgtcgcgtggcatcaacacagccggagaaggccctcgctactaatgaagatggccatttggcagccaccacgaaggggtcggactccctgatcgcttctcgggctccagctcgtcggggccgagcgcctacctaccaccaactcctccacgccctccgagtctagaagatggaggctgactattactgtacagacagtagggacgnggtcggcgttcgtggcgtgggttccgggcgggaacggggaccaaaggcgtacggtacccggtaaccgtacgggttccgaacgccccggaaacgggtccttacccggttccccccgttccgggtccctaacccgttcccttccggttccccccttaccccgtttcccttccgtaaccccgg

SEQ ID NO: 336684 - DNA, 594 bp, Homo sapiens
  misc_feature: GZ8MTXP01D85J2.22.30.C08.1.454.CMB.2.raw
  modified_base (281)..(281): a, c, t, g, unknown or other
  misc_feature (281)..(281): n is a, c, g, or t
  modified_base (374)..(374): a, c, t, g, unknown or other
  misc_feature (374)..(374): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccatttggcagccacacgaaggggtcggatccctgatcgcttcgtcgggctccgagctcgtcggggccgagcgctacctcaccntctccacgccctccagtctgaagatgaggctgacttattactgtcagacagtcgggacgcggtggcgttcgtgggcttggttcgggcgggtagggacccaaggtcgtcggacccggtcctagggttccgacgttcccgaaagggtccgttcccggttcccccgttcgggtcctacccgttccgttcccggttccccgccccttcccgttccgtaacccgg

SEQ ID NO: 336685 - DNA, 523 bp, Homo sapiens
  misc_feature: GZ8MTXP01CINHT.22.30.C08.1.454.CMB.2.raw
  modified_base (282)..(282): a, c, t, g, unknown or other
  misc_feature (282)..(282): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
  modified_base (462)..(462): a, c, t, g, unknown or other
  misc_feature (462)..(462): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtggcatcaacaacagccggagaagggccctcgctactaangaagattggccatttggcagccaccacgaagggggtcggatccctgatcgcttcncgggctccagctctcggggccagcgctacctcaccntctccagccctccagtctagaagntgaggctgactattactgtcagacagtggacgngtggcgtctggctgtcggcggaggaccaagcngccgtctaggttcagcccaaggcttcgccccttggtcactctcgtcccacctccttcgccg

SEQ ID NO: 336686 - DNA, 540 bp, Homo sapiens
  misc_feature: GZ8MTXP01BPXAD.22.30.C08.1.454.CMB.2.raw
  modified_base (186)..(186): a, c, t, g, unknown or other
  misc_feature (186)..(186): n is a, c, g, or t
  modified_base (256)..(256): a, c, t, g, unknown or other
  misc_feature (256)..(256): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagacatacgcgtcacgaccggtgctcgatttagtctgacgtcaaagggaaaggggaggagctctggggagtctgcaccatggcttggaccccactcctcttcctcacccctcctcctccactgcacagggtctctctcccaggttgtactgactcaatcgcctctgcctctgcctccctgggancctcggtcaacctcacctgcgttcttagtagtcaaacacgattactacaccgtcgcgtggcatcaacaanagccggagaaggccctcgctactaatgaagattggccatttggcagccaaccacgaaggggtcggatccctgactcgcttctcgggctccagctcgtcggggccgagcgctaccgtcaccntctccagccctcacgtctagaagntgaggctagacttattactgtcagacatgggacngtggcgtctggctgtcgggagtacgggaccaagctcgaaccgtcgtaggttcacgcccaaggcttcgccccttcggcncgtctcgtccccacctccncgtaaccg

SEQ ID NO: 336687 - DNA, 526 bp, Homo sapiens
  misc_feature: GZ8MTXP01EXNL5.22.30.C08.1.454.CMB.2.raw
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccattttggcagccaccacaagggggtcggatccctgatcgcttctcgggctccagctctcggggccgagcgctaccctcaccntctccagcctccagtctgaagatgaggctgacttatactgtcagacagtgggacgcgtggcgtctggctgtcggcggagggccaagctgccgtctagggttcagcccgaaggcttcgccccttggtcactctcgtcccacctccttcgccg

SEQ ID NO: 336688 - DNA, 557 bp, Homo sapiens
  misc_feature: GZ8MTXP01EKSWR.22.30.C08.1.454.CMB.2.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (375)..(375): a, c, t, g, unknown or other
  misc_feature (375)..(375): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaaacaacngccggagaaggccctcgctactaangaagattggccatttggcagccaccacgaagggggtcggatccctgatcgcttcgtcgggctccagctcgtcggggccgagcgctaccctcaccntcctccacgccctccagtctagaagatggaggctagacttattactgtacaggacagtgggacgcgtggtcgtctggctggttcggcggacggacaagctcgccgtcgtacggttcacggcccgaagggccttcggcccccttcggtcacttcctcgttccccaccttcccttcgtaacccg

SEQ ID NO: 336689 - DNA, 534 bp, Homo sapiens
  misc_feature: GZ8MTXP01CFQ1Y.22.30.C08.1.454.CMB.2.raw
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagcccggagaagggccctcgctacttaangaagattggccattttggcagccaccacgaaggggtcggatccctgatcgcttctcgggctccagctcgtcggggccgagcgctacctcaccntctccagcctccagtctgaagntgaggctgactattactgtcagacagtgggacgcgtggcgtctggctggttcggcggagggaccaaggctgccgtcctaggttcagcccgaaggcttcgccccttcggtcactctcgtcccgcctccgttcaaccg

SEQ ID NO: 336690 - DNA, 577 bp, Homo sapiens
  misc_feature: GZ8MTXP01BVM4P.22.30.C08.1.454.CMB.2.raw
  modified_base (280)..(280): a, c, t, g, unknown or other
  misc_feature (280)..(280): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaangaagattggccattttggcagccaccacgaagggggtcggatccccgtgatcgcttctcgggctccagctcgtcggggccagcgctacctcaccntctccagccctccagtctagaagatgaggctgacttattactgtcagacagtgggacgcgtggcgtcgnggtctcggttcgggacggacgggaccgaaggtccgtcggacccgtcgtacggttccgacgccgtaacggcgttcccggcccccgttcggtcctccgtccgttccgtccccgttccccgtcccgttcgaacccg

SEQ ID NO: 336691 - DNA, 525 bp, Homo sapiens
  misc_feature: GZ8MTXP01D522R.22.30.C08.1.454.CMB.2.raw
  modified_base (375)..(375): a, c, t, g, unknown or other
  misc_feature (375)..(375): n is a, c, g, or t
  modified_base (449)..(449): a, c, t, g, unknown or other
  misc_feature (449)..(449): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaagggccctcgctacttaatgaagattggccatttggcagccaccacgaaggggtcgggatccctgatcgcttctcgggctccagctctcggggccgagcgctacctcaccntctccacgcctccagtctgaagatgaggctgactattactgtcagacatgggacgcgtggcgtctggctgtcgnggaggccaagctgcgtctaggttcagcccaaggcttcgccccttcggtcactcgtcgtcccgccctccttcaaccg

SEQ ID NO: 336692 - DNA, 554 bp, Homo sapiens
  misc_feature: GZ8MTXP01C50DR.22.30.C08.1.454.CMB.2.raw
  modified_base (283)..(283): a, c, t, g, unknown or other
  misc_feature (283)..(283): n is a, c, g, or t
  modified_base (378)..(378): a, c, t, g, unknown or other
  misc_feature (378)..(378): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgccctccctgggagcctcggtcaacctcacctgcgttcttagtagtcaacacgattactacaccgtcgcgtggcatcaacaacagccggagaagggccctcgctacttaangaagattggccattttggcagccaccacgaagggggtcggatccctgatcgtcttctcgggctccagctcgtcggggccgagcgctacctcaccntctccagcctccagtctgaagatgaggctgactattactgtcagacagtgggacgcgtggcgtctggcttggttcggcgggacgggaccaaggtcctcgacccgtccgtaggttcacgcccgaagggcttcgcccccgttcggtcaccttcgtcgttccccacccttccgcgtccg

SEQ ID NO: 336693 - DNA, 517 bp, Homo sapiens
  misc_feature: GZ8MTXP01A3HON.22.30.C08.1.454.CMB.2.raw
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
  modified_base (446)..(446): a, c, t, g, unknown or other
  misc_feature (446)..(446): n is a, c, g, or t
  modified_base (511)..(511): a, c, t, g, unknown or other
  misc_feature (511)..(511): n is a, c, g, or t
tcagacatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccatttggcagccacacaaggggtcggatccctgatcgcttctcgggctccagctcgtcggggccagcgctacctcaccntctcccagccctccagtctgaagatgaggctgactatactgtcagcatgggacgcgtggcgtctggctggttcggnggagggccaagctgaccgtcaggttcagcccaaggcttgccccttggcactctgtcccacctccncgaacg

SEQ ID NO: 336694 - DNA, 559 bp, Homo sapiens
  misc_feature: GZ8MTXP01CSFLU.22.30.C08.1.454.CMB.2.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (532)..(532): a, c, t, g, unknown or other
  misc_feature (532)..(532): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagatggccatttggcagccaccacgaagggggtcggatcccgtgatcgctttcgcgggctccgagctcgtcggggccgagcgctacctcaccntctccagcctccagtctgaagntgaggctgactattactgtcagtacagtgggacgcggtgggcgtcgtcgggcgttcggttcgggcggacggggaccaaggcgtcggcccgtccgtaaggttcacgcccgtaaggccttcgccccgttcggtccnctccgtcgtccccgcctccgttcgccg

SEQ ID NO: 336695 - DNA, 610 bp, Homo sapiens
  misc_feature: GZ8MTXP01BQVR3.22.30.C08.1.454.CMB.2.raw
  modified_base (282)..(282): a, c, t, g, unknown or other
  misc_feature (282)..(282): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
  modified_base (463)..(463): a, c, t, g, unknown or other
  misc_feature (463)..(463): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctactaangaagattggccatttggcagccaccacgaagggggtcggatccctgatcgcttcgtcgggctccagctcgtcggggccgagcgctacctcaccntctccacgcctccagtctagaagntgagctgactattactgtcagtacagtgggacncggtggtcgtcgtggcgttggttccggggnggaacggggaccaaggccgtacggcccggtaaccgtaacgggttccaacggccccgaaagggtcccgttccggcccccccgttcggggtaaccctaccgttccgtttcccggttcccccaccccgttcccttaacccgtaacccggg

SEQ ID NO: 336696 - DNA, 579 bp, Homo sapiens
  misc_feature: GZ8MTXP01AGBEI.22.30.C08.1.454.CMB.2.raw
  modified_base (282)..(282): a, c, t, g, unknown or other
  misc_feature (282)..(282): n is a, c, g, or t
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
  modified_base (394)..(394): a, c, t, g, unknown or other
  misc_feature (394)..(394): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggcctatttggcagccacacgaagggggtcggatcccngatcgcttcgtcgggctccagctcgtcggggccagcgctacctcaccntctccagcctcagtctganatgaggctgactattactgtcagacagtcggggacgcggtggcgttcgtcgggcgtggttccgggcgggacgggaccaaggccgtcggaacccggttccgtagggttcccacggccccgaaagggccttccgccccccttgggtcccacgtccttcggtcccccaccctccgttccgtaacccgg

SEQ ID NO: 336697 - DNA, 521 bp, Homo sapiens
  misc_feature: GZ8MTXP01DQOI6.22.30.C08.1.454.CMB.2.raw
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
  modified_base (517)..(517): a, c, t, g, unknown or other
  misc_feature (517)..(517): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccaccacgaagggggtcggatccctgatcgctttctcgggctccagctcgtcggggccagcgctaccctcaccntctccagcctcagtctgagntgaggctgacttattactgtcagacagtgggacncgtggcgtctgggctggttcggcggagggccagctgaccgtctaggttcacgccaggcncgccccttggcnctctcgtcccacctccncgcg

SEQ ID NO: 336698 - DNA, 543 bp, Homo sapiens
  misc_feature: GZ8MTXP01EYLQX.22.30.C08.1.454.CMB.2.raw
  modified_base (187)..(187): a, c, t, g, unknown or other
  misc_feature (187)..(187): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatccgccctctgcctctgcctccctgggacncctcggtcaacctcacctgcgttcttagtagtcaaacacgattactacaccgtcgcgtgcatcaaacaacagccgagaagggccctcgctactaangaagattggcatttggcagccaccacgaagggggtcgggatccctgatcgcttctcgggctcagctcgtcgggccgagcgctacctcaccntctccacgccctcagtctgaagatgaggctgactaattactgtcagacatgggacgcggngggtcgtcgtggcttggtcggcgggacggaccaagctcgaccgtcgtaggttcacgcccgaaaggcttcgccccttcggcactctcgttccccgcctccgttcgaaccg

SEQ ID NO: 336699 - DNA, 555 bp, Homo sapiens
  misc_feature: GZ8MTXP01C41IT.22.30.C08.1.454.CMB.2.raw
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccattttggcagccaccacaagggggtcggatccctgatcgctttcncgggctccagctcgtcggggccgagcgctacctcaccntctccagccctccagtctgaacgatgaggctgactattactgtacagacagngggacgcgtcggcgtcgtggcgtcggttcggcgggacgggaccgaaggctcggccgtccgtaggttcacgccgaacggcttcgccccgttcggtccactcctcgtccccgccctcgttcccccgaag

SEQ ID NO: 336700 - DNA, 554 bp, Homo sapiens
  misc_feature: GZ8MTXP01BJM9L.22.30.C08.1.454.CMB.2.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaangaagattggccatttggcagccaccacgaagggggtcgggatccctgatcgcttctcgggctccagctcgtcggggccgagcgcctacctcaccntcctccagccctccagtctgaacgatggaggctgactattactgtcagacngtagggacgcgtggcgtgtggctggtcggcgggagggaccaaggctcgaccgtcgtacggttcacggcccgaaggccttcgccccttacgggtccactccgtcgtcccgccctccgttcgtaaccgg

SEQ ID NO: 336701 - DNA, 536 bp, Homo sapiens
  misc_feature: GZ8MTXP01E4QS6.22.30.C08.1.454.CMB.2.raw
  modified_base (280)..(280): a, c, t, g, unknown or other
  misc_feature (280)..(280): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (504)..(504): a, c, t, g, unknown or other
  misc_feature (504)..(504): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctgctactaangaagatggccatttggcagccaccacgaagggggtcggatcccgtgatcgcttctcgggctccagctcgtcggggccgagcgctaccgtcaccaatctccagccctccagtctagaacgatggaggctagacttattactgtacagacagtgggacncgtggcgtcnggctgtcggcggaggaccaagctgcccgtctaggttcagcccgaaggcttcgccccncggtcactctcgtccccgcctccttcgaaccg

SEQ ID NO: 336702 - DNA, 732 bp, Homo sapiens
  misc_feature: GZ8MTXP01CAXZL.22.30.C08.1.454.CMB.2.raw
  modified_base (279)..(279): a, c, t, g, unknown or other
  misc_feature (279)..(279): n is a, c, g, or t
  modified_base (383)..(383): a, c, t, g, unknown or other
  misc_feature (383)..(383): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctcgctactaangaagattggctatttggcagcccaccacgaagggggtcggatcccgtgactcgtcttcgtcgggcctcgagctcgtcggggccgagccgcctacccgtcacccntcctccacgtcccctaccacgtctggaaacgtagtggacggtctaggtaacccttagtttaccgttgtacgacgtaccgaaggttcggggaaccgtcgggttcgggtccgtttccgtcggggtccgttgggtttacccgggggacggggaaccggggtaaccgaaacggtcccgttacgggacccccggtttaaccggttaacggggttacccgaaccggggaccccgtaaaccggggtcccgttccccgggttccccccccggtttacggggtcccctaaccccggtttcccgtttccccgggtttaccccccccggttccccctttccccgttcggttaaccccggg

SEQ ID NO: 336703 - DNA, 593 bp, Homo sapiens
  misc_feature: GZ8MTXP01AI4W4.22.30.C08.1.454.CMB.2.raw
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
  modified_base (376)..(376): a, c, t, g, unknown or other
  misc_feature (376)..(376): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacngccggagaaggccctcgctacttaangaagattggcatttggcagccaccacgaagggggtcgggatcccgtgactcgcttctcgggctccagctcgtcggggccgagcgctaccgtcaccntcctccacgcccttccagtctagaacgatcggaggctgaactacttactgtcagacagtgggacgcggtggcgtcgtncggggggggggtntcgggcggagggacctaaggctcggacccgtcgtacggttcacggaccgaacggccgttccgccccgttccgggtaaccaccgttccgttcccggttccccggttcccctcccttccgtaacccgg

SEQ ID NO: 336704 - DNA, 562 bp, Homo sapiens
  misc_feature: GZ8MTXP01EOQJ8.22.30.C08.1.454.CMB.2.raw
  modified_base (281)..(281): a, c, t, g, unknown or other
  misc_feature (281)..(281): n is a, c, g, or t
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacaggatctctctcccaggttgtactgactcaatcgccctctgcctctgcctccctgggagcctcggtcaacctcacctgcgttcttagtagtcaacacgattactacaccgtcgcgtgcatcaacaacagccggagaacgggccctcgctactaangaagatggcctatttggcagccacacgaagggggtcggatccctgatcgcttcgcggctccagctccgtggggccagccgctaaccctcnccatcctccacgcctccagtcctagaacgatggacggctagtacttattacngtacagacagtgggacgcgtgggccttcgtggcgtggttcgggacgggaggaccagcctggccgtcgttaggccacggcccgaacgggcttccgcccccgtggtccaactccgtaccgttcccctcccgttcgtaaccg

SEQ ID NO: 336705 - DNA, 526 bp, Homo sapiens
  misc_feature: GZ8MTXP01A5J2V.22.30.C08.1.454.CMB.2.raw
  modified_base (280)..(280): a, c, t, g, unknown or other
  misc_feature (280)..(280): n is a, c, g, or t
  modified_base (389)..(389): a, c, t, g, unknown or other
  misc_feature (389)..(389): n is a, c, g, or t
  modified_base (447)..(447): a, c, t, g, unknown or other
  misc_feature (447)..(447): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaangaagattgcatttggcagcacacaaggggtcggatcctgatcgcttctcgggctccagctcgtcggggccgagcgctacctcaccaatctccagcctccagtctagaanatgaggctagactatactgtcaagacagtgggacgcgtggcgtctggcctggttcggnggacgggaccaagctgccgtctaggcagcccgaaaggccttcgccccttcggtcacgtctcgttccccncctccncgcg

SEQ ID NO: 336706 - DNA, 557 bp, Homo sapiens
  misc_feature: GZ8MTXP01DT9G0.22.30.C08.1.454.CMB.2.raw
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccattttggcagccaccacgaaggggtcggatcccgtgatcgcttcncgggctccagctcgtggggccagcgctacctcaccntctccagcctccagtctgaagatggaggctgactattacngtcagacntagggacgcgtggcgtctgggtctggttcggcgggaagggaccaaggcctggaccgttccgtaaggttcaacggcccgaaaggccttcgcccccttggtcacgttctcgttccccacccgttccttcgtaaccgg

SEQ ID NO: 336707 - DNA, 531 bp, Homo sapiens
  misc_feature: GZ8MTXP01D5QJ1.22.30.C08.1.454.CMB.2.raw
  modified_base (374)..(374): a, c, t, g, unknown or other
  misc_feature (374)..(374): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaaggggtcggatccctgatcgcttctcgggctccagctcgtcggggccagcgctacctcaccntctccagcctccagtctgaagatggaggctgaactattactgtcagacatgggacgcgtggcgtctggctggttcggcggaggaccaagctcgccgtctaggttcagcccgaaggcttcgccccttcggtcactctcgttccccacctccttcgccg

SEQ ID NO: 336708 - DNA, 554 bp, Homo sapiens
  misc_feature: GZ8MTXP01C21FH.22.30.C08.1.454.CMB.2.raw
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
  modified_base (462)..(462): a, c, t, g, unknown or other
  misc_feature (462)..(462): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctgctactaangaagattggccattttggcagcccaccacgaagggggtcgggatccccgtgatcgctttcgcgggctccagctcgtcggggccgagcgcctacctcaccaatcctcccagccctccagtctgaacgntgaggctgactattactgtcagacagtgggacgcgtggcgtcgtgggctggttcggngggaacggccaagcgtcgccgtcgtaggttcgacgcccgaagggtcttacgccccgttggtccacgtctcgtccccgcctccgcgtaaccgg

SEQ ID NO: 336709 - DNA, 532 bp, Homo sapiens
  misc_feature: GZ8MTXP01BQ252.22.30.C08.1.454.CMB.2.raw
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
  modified_base (374)..(374): a, c, t, g, unknown or other
  misc_feature (374)..(374): n is a, c, g, or t
  modified_base (449)..(449): a, c, t, g, unknown or other
  misc_feature (449)..(449): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccatttggcagccacacgaaggggtcggatcccngatcgcttctcgggctccagctcgtcggggccgagccgctacctcaccntctccagccctccagtctgaagatgagctgactattactgtcagacagtgggacgcgtggcgtctggctgtcggnggaggaccagctgccgtctagggttcacgcccgtaaggccttcgcccccttggtcactctcgttccccacctccttcgaaccg

SEQ ID NO: 336710 - DNA, 527 bp, Homo sapiens
  misc_feature: GZ8MTXP01C892F.22.30.C08.1.454.CMB.2.raw
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
  modified_base (522)..(522): a, c, t, g, unknown or other
  misc_feature (522)..(522): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtcctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccattttggcagccacacaaggggtcggatccctgatcgcttcncgggctccagctcgtcggggccgagcgctacctcacntctccagcctcagtctganatgagctgactatactgtcagacatgggacgctggcgtnggctgttcggcggaagggccaagcctagcccggtctaggttcacgcccgaaagggccttcgccccttggtccacgtctcgtccccacctccncgtcg

SEQ ID NO: 336711 - DNA, 546 bp, Homo sapiens
  misc_feature: GZ8MTXP01AKV73.22.30.C08.1.454.CMB.2.raw
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
  modified_base (540)..(540): a, c, t, g, unknown or other
  misc_feature (540)..(540): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccattttggcagccaccacgaagggggtcgggatccctgatcgcttctcgggctccagctcgtcggggccgagccgctacctcaccntctccagcctcagtctgaagntgaggctgactatactgtcagacagtcgggacgcgtggcgtctgggctggttcgggcggaggggacccaaggcctcggaccgtcctaggttcacgcccgaaggccttcgcccccttggtccactctcgtccccgccctccncgtccg

SEQ ID NO: 336712 - DNA, 628 bp, Homo sapiens
  misc_feature: GZ8MTXP01BQQRV.22.30.C08.1.454.CMB.2.raw
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacaanagccggagaaggccctcgctacttaangaanattggcctatttggcagccacacgaaggggtcggatccctgatcgcttcgtcggctcagctcgtccggggcagcgctaccgtcaccntcctccagccctcagtctgaagntgaggctagacttatactgtacagtacaagtgggaccgtcggtcgggtccgttcgtcgggtcttagggttccggggcgggtaacggggacccaaaggtccgtacgggtacccgtccgtacgggttccgaaccggccccgaaagggcccttaccgggcccccccgtttcggggtccctaacccgttcccgttacccggtttaccccccaccccggtttcccttaacccgtcccgg

SEQ ID NO: 336713 - DNA, 540 bp, Homo sapiens
  misc_feature: GZ8MTXP01A77VQ.22.30.C08.1.454.CMB.2.raw
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
tcagacatacgcgtcacgaccggtgctcgatttagtctgacgtcaaagggaaagggagagctctggggagtctgcaccatggcttggaccccactcctcttcctcaccctcctcctacactgcacagggtctctctcccaggttgtactgactcaatcgccctctgcctctgcctccctgggagcctcggtcaacctcacctgcgttcttagtagtcaacacgattacacaccgtcgcgtggcatcaacaacagccggagaagggccctcgctacttaatgaagattggccatttggcagccaccacgaaggggtcggatcccgtgatcgcttctcgggctcagctcgtcggggccgagcgctacctcaccntctccagcctcagtctgantgaggctgactattactgtcaggacagtgggacgcgtggcgtcgtgggcttggttcggcgggacgggaccaagccgtcgaccggtctaaggggttcacgcccgaaggcttcgccccttggtccactctcgtcccacctccgttcgaacg

SEQ ID NO: 336714 - DNA, 558 bp, Homo sapiens
  misc_feature: GZ8MTXP01DBGYI.22.30.C08.1.454.CMB.2.raw
  modified_base (279)..(279): a, c, t, g, unknown or other
  misc_feature (279)..(279): n is a, c, g, or t
  modified_base (374)..(374): a, c, t, g, unknown or other
  misc_feature (374)..(374): n is a, c, g, or t
  modified_base (551)..(551): a, c, t, g, unknown or other
  misc_feature (551)..(551): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacacagccggagaaggccctcgctacttaangaagattggccattttggcagccacacgaaggggtcggatcccctgatcgctttcgtcgggctccagctcgtcggggccgagcgctacctcaccntctccagccctccagtctagagatgaggctgactagttactgtcagtacagtaggggaccgcgttggggccgttcgtgggtcctggtttcgggcgggaagggaccaaaggctggaccgtccgtaggttcacgcccgaaggccttcgcccccttggtccactctcgtcccacccgtcncgtaacg

SEQ ID NO: 336715 - DNA, 702 bp, Homo sapiens
  misc_feature: GZ8MTXP01EAJNW.22.30.C08.1.454.CMB.2.raw
  modified_base (293)..(293): a, c, t, g, unknown or other
  misc_feature (293)..(293): n is a, c, g, or t
  modified_base (398)..(398): a, c, t, g, unknown or other
  misc_feature (398)..(398): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgccctcccgtgggacgcctcggtcaaccctcacctgtcgttcttagtagtcaaacacgtattactacaccgtcgcgtggcatcaaacaacaggccggaagaacgggccctcgctaactaangaaagtattggcctagtttggcacgccaaccgacggaagggggtcggactccctgactcgcttcgtcgggctcagctcgtcggggccgagcgcctacctccaccnctcctccaccgccctccgtacgtactaggaaagtactaggacgggtcttacggtaaacctttacgtttaaccgtcgttacgaacggtaaccgtaggtacggggaaccgtcggggtcgggtccggtttcgtcgggtcgtttcggggttccggggacggggtaacgggaacccgtaaggtccgtacggcccggttaaccgtacggttaccgaccggttacccgaacggtcccttcccggcccccgttcgggtaacctaccgttcccgttacccggtcccccttacccttcccgttccgtaacccgg

SEQ ID NO: 336716 - DNA, 578 bp, Homo sapiens
  misc_feature: GZ8MTXP01AF1P0.22.30.C08.1.454.CMB.2.raw
  modified_base (185)..(185): a, c, t, g, unknown or other
  misc_feature (185)..(185): n is a, c, g, or t
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacaggccggagaagggccctgctacttaangaagattggcctatttggcagccaccgacgaagggggtcggactccctgatcgcttcgtcgggctccagctcgtcggggccgagcgctaccgtcaccntcctccacgccctcagtctagaagntggagctgactattactgtacagacagtgggacgcggtggcgtcgtgggcgtggtcgggcggagggaccaaggtcgtcggccgtccgtagggttccacgacccgagggtccttccggcccccttcgggtccctaccgtccgtccgttcccccacccgttccttccgtaaccgg

SEQ ID NO: 336717 - DNA, 569 bp, Homo sapiens
  misc_feature: GZ8MTXP01AEJ32.22.30.C08.1.454.CMB.2.raw
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggccattttggcagccaccacgaagggggtcggatccctgatcgcttcgtcgggctccagctcgtcggggccgagcgctacccgtcacccntcctccacgccctccagtctagaacgatgaggctgactattactgtcagacagtgggacgcggtggcgtntgggcttggttcggcgggagggaccaaggcgtcggaccggtctggttcacgttcccgaaaggccttccgccccgttcggtccacctccgttccgttccccgccctccgttcgtaacccg

SEQ ID NO: 336718 - DNA, 631 bp, Homo sapiens
  misc_feature: GZ8MTXP01EUMB7.22.30.C08.1.454.CMB.2.raw
  modified_base (283)..(283): a, c, t, g, unknown or other
  misc_feature (283)..(283): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (451)..(451): a, c, t, g, unknown or other
  misc_feature (451)..(451): n is a, c, g, or t
  modified_base (549)..(549): a, c, t, g, unknown or other
  misc_feature (549)..(549): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaaccctcacctgcgttcttagtagtcaacacgattactacaccgtcgcgtggcatacaacaacagccggagaaggccctcgctacttaangaagattggacctatttggcagccaccacgaagggggtcggactccctgatcgcttcgtcgggctcagctcgtcggggccgagcgctaccctcaccntcctccncgcctccagtcagaacgagtggaggctagacttaatctaggtccaagacgtaagtcgggggacncgggtcgggtccgtcgtgggtccgttggttccggggcgggacgggaccaaggtcctcggaccgtccgtaaggttccacggttccccgaaagggtcccncccgggttccccccgttacgggttaacccctaccgtttcccgttccccggttcccccgttaccccgtcccgttaaccggtcg

SEQ ID NO: 336719 - DNA, 571 bp, Homo sapiens
  misc_feature: GZ8MTXP01ALB5G.22.30.C08.1.454.CMB.2.raw
  modified_base (185)..(185): a, c, t, g, unknown or other
  misc_feature (185)..(185): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (442)..(442): a, c, t, g, unknown or other
  misc_feature (442)..(442): n is a, c, g, or t
  modified_base (506)..(506): a, c, t, g, unknown or other
  misc_feature (506)..(506): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacngccggagaaggccctcgctacttaangaagattaggccattttggcagccaccacgaagggggtcggatccctgatcgcttctcgggctccagctcgtcgggccgagcgctacctcaccaactcctccacgccctccagtctgaaacgatggaggctggactattactggtcagacagtggacgcgnggcgtctcgggcgtggttcgggcggacggggaccaacggcctcggacccgtccgtgggttaccncgcccgaaggccttccggcccccttcgggtccactccgtcgttccccgccctccgcgtaacccgg

SEQ ID NO: 336720 - DNA, 598 bp, Homo sapiens
  misc_feature: GZ8MTXP01AC5HQ.22.30.C08.1.454.CMB.2.raw
  modified_base (186)..(186): a, c, t, g, unknown or other
  misc_feature (186)..(186): n is a, c, g, or t
  modified_base (280)..(280): a, c, t, g, unknown or other
  misc_feature (280)..(280): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacncctcggtcaacctcacctgcgttctagtagtcaacacgattacacaccgtcgcgtggcatcaacaacagccggagaagggccctcgctactaangaagattggcctatttggcagccaccacgaagggggtcggatcccgtgactcgtcttcgtcgggctccgagcgtcgtcggggccagccgctaccctcacccntctccagccctcagtctagaagntgaggctgacttatctgtcagactagtggggacgcggtggcgttcgtcgggcgttgggtccgggcggggtaacggggaccaacggcgtacggacccggttccgtaaggttccacggacccgaacggtccgttcccggccccttcgggccctaccgtcgttcccgttccccgccctcccgttccgtaacccggg

SEQ ID NO: 336721 - DNA, 669 bp, Homo sapiens
  misc_feature: GZ8MTXP01BM34Z.22.30.C08.1.454.CMB.2.raw
  modified_base (285)..(285): a, c, t, g, unknown or other
  misc_feature (285)..(285): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctccaggttgtactgactcaatcgccctctgcctctgcctcctgggagcctcggtcaacctcacctgtcgttcttagtacgtcaacacgattactacaccgtcgcgtggcatcaaacaacaggccggaagaagggccctcgctacttaangaagattggcatttgcagcacacgaggggtcggactcctgatcgcttcgtcgggctcgagctcgtcggggccgagccgctaccgtacaccntcctccacgccctcacgtctagaacgntggacggctacggtacttaattacgtgtacgagaacagtagggacgcgggtcggcgttcgtggtcgtgggttccggggacgggaacggggaacccgtaaggccgtacggtaccccggtaaccggtaacgggttcccgaacgggaccccggtaaacgggtccccgttccccggttccccccgggtttccggggtaacccctacccgtttcccgttccccgggttaccccccgttcccccgttccccggtttccccgtaaccccgggg

SEQ ID NO: 336722 - DNA, 542 bp, Homo sapiens
  misc_feature: GZ8MTXP01AOHWC.22.30.C08.1.454.CMB.2.raw
  modified_base (281)..(281): a, c, t, g, unknown or other
  misc_feature (281)..(281): n is a, c, g, or t
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (537)..(537): a, c, t, g, unknown or other
  misc_feature (537)..(537): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaangaagattggcctatttggcagccaccacgaagggggtcggatcccngatcgcttctcgggctcagctcgtcggggccgagcgcctactcaccntcctccagcctccagtctacgaagntgaggctagactattactgcagacagtgggacncgtggctcgnggctgtcggcggaggacctagctcgacctcgaggttcaacggccgaaaggccttcgccccgttacggtcctactccgtcgtccccgcccttcccncgtcg

SEQ ID NO: 336723 - DNA, 610 bp, Homo sapiens
  misc_feature: GZ8MTXP01AO5DP.22.30.C08.1.454.CMB.2.raw
  modified_base (285)..(285): a, c, t, g, unknown or other
  misc_feature (285)..(285): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacgcctcggtcaacctcacctgcgttcttagtagtcaacacgtattactacaccgtcgcgtggcatacaacaacagccggagaacggccctcgctactaangaagattggcctagtttggcagccaccgacgaagggggtcggactcccgtgactcgtcttcgtcggggcctcgagcgtcgtcggggccgagcgctacctcaccntcncacgcctcagtctagacgngtgaggctgacttatactgtacaganagtgggacgcggtcggcgttcgnggtcgtggttccggggacgggacgggaccgaacggtcgtaccggtacccggttaacggtaacggttccgaaccggcccgaaacggtccgttacccgccccgttcggtcctacgtcccgtccgtccccgttccctccgttccgtaacccgg

SEQ ID NO: 336724 - DNA, 638 bp, Homo sapiens
  misc_feature: GZ8MTXP01BKSWF.22.30.C08.1.454.CMB.2.raw
  modified_base (282)..(282): a, c, t, g, unknown or other
  misc_feature (282)..(282): n is a, c, g, or t
  modified_base (379)..(379): a, c, t, g, unknown or other
  misc_feature (379)..(379): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggagcctcggtcaaccctcacctgtcgttcttagtagtcaacacgattactacaccgtcgcgtgcatcaacaacagccggagaaggccctcgctactaangaagattggcatttggcagccaccgacgaagggggtcggactccctgatcgcttcgtcgggctccgagcgtcgtcggggccgagcgctacctcaccntcctccacgtccctcctagtcgtagaacgagtaggagggtctaggtaaccttaagtttacgtgtaccgagacaggttcggggacgtcggtgggtccgttcgtcgggtcgttcgggttcgggcgggaacggggtaccgaaaggtcgtacggaccgtcccgtaggttaccgacgttacccgaaggtcccgttaccggcccccgttcgggtccctaccgtccgttcccggttccccgttccccttcccgttaaccgtcccgg

SEQ ID NO: 336725 - DNA, 538 bp, Homo sapiens
  misc_feature: GZ8MTXP01A1AWX.22.30.C08.1.454.CMB.2.raw
  modified_base (282)..(282): a, c, t, g, unknown or other
  misc_feature (282)..(282): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
  modified_base (532)..(532): a, c, t, g, unknown or other
  misc_feature (532)..(532): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagattggctatttggcagccaccacgaaggggtcggatcccctgatcgcttctcgggctccagctcgtcggggccgagcgctacccgtcaccntctccacgcctcagtctgaagntgaggctgacttattactgtcagacagtgggacgngtggcgtcnggctggtcggcggagggacctaagcgtgaccgtcgtaggcncgccgaaggccttcgccccgttgtccnctcctcgtccccgcccgttcncgtccg

SEQ ID NO: 336726 - DNA, 575 bp, Homo sapiens
  misc_feature: GZ8MTXP01CH76H.22.30.C08.1.454.CMB.2.raw
  modified_base (372)..(372): a, c, t, g, unknown or other
  misc_feature (372)..(372): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccacacgaaggggtcggatccctgatcgcttctcgggctccagctcgtcggggccagcgctaccgtcaccntctccagcctcagtctgacgatgaggctgactattactgtacagacagtgggacgcgtgggcgtcgtggctggttcggcggacgggaccaaggctcggaccgtccctaggttccagttccccgaaagggtccttaccggcccccgttcgggtccctaccgttccgttccggttcccccggccccttcccgttccgtaacccgg

SEQ ID NO: 336727 - DNA, 552 bp, Homo sapiens
  misc_feature: GZ8MTXP01AZ235.22.30.C08.1.454.CMB.2.raw
  modified_base (281)..(281): a, c, t, g, unknown or other
  misc_feature (281)..(281): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (524)..(524): a, c, t, g, unknown or other
  misc_feature (524)..(524): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaangaagattggcctattttggcagccaccgacgaagggggtcgggatccccgtgactcgcttcgtcgggctccagctcgtcggggccgagcgcctacctcaccntcctccagccctcagtctgaagntgaggctgactatactgtcagacagtgggacncggtggcgtcgnggctggtcgggcggtacgggacctaagcgtgccgtcgtaggttcacgcccgaaggcttccgccccttcggtccnctccgtccgtccccgcctccgcgtccgg

SEQ ID NO: 336728 - DNA, 672 bp, Homo sapiens
  misc_feature: GZ8MTXP01DC3Y6.22.30.C08.1.454.CMB.2.raw
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
tcagacatacgcgtcacgaccggtgctcgatttagtctgacgtcaaagggaaagggggagagctctggggagtctgcaccatggcttggaccccactcctcttcctcaccctcctcctccactgcacagggtctctctccaggttgtactgactcaatcgccctctgcctctgcctcccgtgggacgcctcggtcaacctcacctgcgttcttagtagtcaacacgtattactacaccgtcgcgtggcatcaacaacagccggagaaggccctcgctactaangaagattggccatttggcagccacacgaaggggtcggatcccgtgatcgtcttcgcgggctccagctcgtcggggccgagcgctacctcaccntcctccacgccctccagtcagaagntggaggctagacttattactgtacagactaagtggggacgtcggtcgggtcggtcgtgggtcgttgggttccggggacgggtaacgggaaccgtaacggtccgtacgggaacccggttccgttaacggggttcccgaaacgggacccccggaaacgggtccccgttccccgggttccccccccgttaccggggttaaccccaaccccgtttcccgttcccccgggtttccccccgttacccccgttccccgttaacccgttaaccccgggg

SEQ ID NO: 336729 - DNA, 601 bp, Homo sapiens
  misc_feature: GZ8MTXP01D7XZJ.22.30.C08.1.454.CMB.2.raw
  modified_base (353)..(353): a, c, t, g, unknown or other
  misc_feature (353)..(353): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagcctgagaagggccctcgctactaatgaagattggccatttggcagccaccgacgaagggggtcggatcccgtgatcgcttctcgggctcgagctcgngggggcagccgcctaaccctcaaccatcctcccgacgtccctccacgtcgtacgaagatggaggtctaggtacttattacctgtcagacagttggggacggtcgtgggtccgtcgtcggtcgttgggttcggacggggtagggtacccaagtcgtcggaaccgtcgttaggtcgacgcccgaacggttccgttcgcccccgtaacggtcctaaccgttcgtccttcccctaaccccgttctaacccgg

SEQ ID NO: 336730 - DNA, 717 bp, Homo sapiens
  misc_feature: GZ8MTXP01BFBOB.22.30.C08.1.454.CMB.2.raw
  modified_base (281)..(281): a, c, t, g, unknown or other
  misc_feature (281)..(281): n is a, c, g, or t
  modified_base (382)..(382): a, c, t, g, unknown or other
  misc_feature (382)..(382): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctactaangaagattggcatttggcagccaccagaaggggtcggatcccgtgactcgtcttcgtcgggctccagcgtcgtcggggccgagccgccgtaccctccgaccnctcctcccacgccctaccgtacgtctagaaacgtagttaggaacgggtctacggtaacttaacgttaaccttggtacgagaaccgtaggtacgggggtaacccgcggggttcggggtccggttccggttcggggtaccgtttcggggtttacccggggaccggggtaaacgggggtaaccccgaaagggtccgtacgggtaccccggttaaccggtacgggttaccgtacccggaccccgaaacgggtcccttacccgggttccccccttcggggtccctacccgttccggttccccgttcccccggttacccctcccgtttcccgtaacccggg

SEQ ID NO: 336731 - DNA, 609 bp, Homo sapiens
  misc_feature: GZ8MTXP01BO2XD.22.30.C08.1.454.CMB.2.raw
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
  modified_base (588)..(588): a, c, t, g, unknown or other
  misc_feature (588)..(588): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactacaccgtcgcgtggcatcaacaacagccggagaagggccctgctacttaangaagattggcctattttggcagccaccgacgaagggggtcggatcccgtgatcgcttcgtcgggctcagctcgtcggggccagcgctaccgtcacctntctccagccctcagtctagacgatggaggctagtactattactcgtacagacagtaggggaccgcggtggggcgttcgtcgggtcgttggttccggggcgggaacggggaccgaaggtccgtacggtaaccccgtcgtaacggttccgacgcccgaaacggtccgttcccgaccccgttcggcctaccgttcccgttccgttaccccnccccttccgttccgtaacccg

SEQ ID NO: 336732 - DNA, 690 bp, Homo sapiens
  misc_feature: GZ8MTXP01BLKOH.22.30.C08.1.454.CMB.2.raw
  modified_base (186)..(186): a, c, t, g, unknown or other
  misc_feature (186)..(186): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacaggatctctctcccaggttgtactgactcaatcgccctctgcctctgcctccctggggancctcggtcaacctcacctgcgttcttagtagtcaaacacgattactacaccgtcgcgtggcatcaacaacagccggagaagggccctcgctactaatgaagtatggcctatttggcagccacgacgaggggggtcggatccctagactcgcttcgtcggctcgagcgtcgtcggggcgagccgcctaaccctcaaccatcctacacgccctcgacgtctagaagtatggaacggtctaggtaaaccttagttaacgtacggtcaaacgggtacctaaggttccgggggaacgtcggttcggggtccgttcgggtaacgggtccgttcggggttccggggaacgggggtaacgggaaccccgtaaaggtcccgttacgggaacccgttaccgagggggtaccaaccgggtaccccggaaagggttccccttccgggacccccccgttgggtaccctaaccgttcccgttccggttacccccctaaccccggttccttaacccggg

SEQ ID NO: 336733 - DNA, 636 bp, Homo sapiens
  misc_feature: GZ8MTXP01BGK0A.22.30.C08.1.454.CMB.2.raw
  modified_base (284)..(284): a, c, t, g, unknown or other
  misc_feature (284)..(284): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaaccctcacctgcgttcttagtagtcaacacgattactacaccgtcgcgtggcatcaaacaacaggccggagaaggccctcgctactaangaagattggcctatttgcagccacgacgaagggggtcggatcccgtgatcgtcttcgtcgggctccgagcgtcgtccgggggccgtagccgtcctacccgtaccacccaactccctacccacgtcccctccgagttccgtagaagattacggaagggtccttaggtaaccttaatttaacgtgttaccaggacaaggtcgggacgtcgtcgggcgtcgtggtcgttcgggtcgggacggaacgggacctaagccgtcggtaccgtcgttaggccacgacccggtaaaggcccttaccggcccccttcgggaacctccttcgtccgttccccgcccttaaccttcgtaacccg

SEQ ID NO: 336734 - DNA, 554 bp, Homo sapiens
  misc_feature: GZ8MTXP01A2HCU.22.30.C08.1.454.CMB.2.raw
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
  modified_base (319)..(319): a, c, t, g, unknown or other
  misc_feature (319)..(319): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (530)..(530): a, c, t, g, unknown or other
  misc_feature (530)..(530): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaanagccggagaggccctgctactangaagattggctatttggcagcaccagaaggggtcggatcccngatcgcttcgtcgggctccgagcctcgtcggggccagccgcctacccgtcacccaatccctccacgcccctccaacgtctaggaagatggacggtctagaacttaattacgtgtacagacaagtcgggacncgtgggcgtntggctggtcggcggacggacctagcctggaccctcgtagcgacgcccgaggcccttccgccccttgtccnctcgtcctcccacctccttcaacg

SEQ ID NO: 336735 - DNA, 568 bp, Homo sapiens
  misc_feature: GZ8MTXP01BAK23.22.30.C08.1.454.CMB.2.raw
  modified_base (282)..(282): a, c, t, g, unknown or other
  misc_feature (282)..(282): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (536)..(536): a, c, t, g, unknown or other
  misc_feature (536)..(536): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactacaccgtcgcgtggcatcaaacaacagccggagaagggccctgctactaangaagattggcatttggcagccacacgaagggggtcggatcctgatcgcttctcgggctccagctcgtcggggccgagccgctaccgtcaccntcgtccacgcctccagtctagaacgntggaggctgacttattacgtntcagacagtggggacgcgtggcgtcgtggtcgtggttcggcgggacgggacctaaggcgttcggaccgtcgtaggttcgacgttcccgaaggccttccggccccttcgggtaacncctcgtccgtcccggcccctcgttcgaaccgg

SEQ ID NO: 336736 - DNA, 790 bp, Homo sapiens
  misc_feature: GZ8MTXP01EGOC6.22.30.C08.1.454.CMB.2.raw
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctccaggttgtactgactcaatcgccctctgcctctcgcctcccgtgggagcctcggtcaacctcacctgcgttcttagtagtcaacacgattacacaccgtcgcgtggcatacaacaacaggccggagaacggccctcgctacttaangaagattgctatttgcagccacacgaggggtcggatccngactcgcttcgtcggctccgagcgtcgtcggggccgagtccgactccctacaccctaagtcctaccacgtccccgtaccgaacggtccttacgggaaacgtaagttcgggaacgggtaccttacgggtaaacccgttttaacgtttaaccttacgggttacccgtaaagggtaacccgagggtttaaacgggggacccggttacccggggttgggggtcccggtttaaccgggttcgggtcggttccggggtttacccgggggaccggggtaaaaccggggggacccaaaacgggttccggtacccggggtaaacccggttccgttaacgggttcccgaaacggaccccgttaaacggggcccttcccccgggttcccccccggttcggggtaaccccgttaacccttccgggtttacccccgttcccccttaaccccgttcccccggtttaaccctaaccccgggg

SEQ ID NO: 336737 - DNA, 668 bp, Homo sapiens
  misc_feature: GZ8MTXP01B7EIU.22.30.C08.1.454.CMB.2.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattacacaccgtcgcgtggcatcaacacagccggagaaggccctcgctactaangaagattgctatttgcagccacacgaaggggtcggatccctgatcgctttcgcgggctccagctcgtcggggccgagcgcctacctcaacctntcctccacgccctaccacgtctagaacgtatggacggctagacttattacgtgtcgaagactagcggggaccgtcggtcgggtccgtcgttcgggccgttagggttcccggggacgggtaaccgggggacctaaacggtccgtaccgggacccggttaacccggttaacgggttcccgtaaaccgggccccgaaacggggtcccttacccgggccccccttacggggttaacccctacccgttccccgtttcccgggttccccccgttccccgttccccgttccggtaaccccggg

SEQ ID NO: 336738 - DNA, 626 bp, Homo sapiens
  misc_feature: GZ8MTXP01EKTU1.22.30.C08.1.454.CMB.2.raw
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacgcctcggtcaaaccctcacctgcgttcttagtagtcaaacacgattacacaccgtgcgtggcatcaaacaanagccggaagaacggccctcgctactaangaagattggcctagttttggcacgccaccgaacgaagggggtcggatccctgactcgctttcncgggctccagcctcgtcgggccgagcgctaccctcaccctntctccancccctcacgtctagaagatggaaggctagacttaattaaccgtgtacgagaaccagtacggggactcgggtcgggtcgttccgtgggcgttcgggttcgggcggggaaagggccaacggcctcggaccgtaaccgtaaggttccgcgacccgaaggggccttcccggttccccttacgggttcccaccgttccgtccgttccccgttacccctccgttccgtaaccggg

SEQ ID NO: 336739 - DNA, 692 bp, Homo sapiens
  misc_feature: GZ8MTXP01CQWLE.22.30.C08.1.454.CMB.2.raw
  modified_base (297)..(297): a, c, t, g, unknown or other
  misc_feature (297)..(297): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatccgccctctgcctctcgccctcccgtgggacgcctccggtcaacctcacctgtcgttcttagtagtcaaacacgtattacaccaccgtcgcgtggcatacaaacaacaggccggagaacgggccctcgactaactaangaagattggctagtttgactacgaccaccgaggaacgggggtcggactcccgtgacgtcgtcttcgtcgggctccgagcgtcggtccggggccgacgccgtacctacccaaccactcctccaccgacccgtccagtaccgtagacgtagtcgtaggacgtagtaacttaacgtacttacgacgtacgaacgtacgtacgggacgggtacgtcggggtcggtcggttacgggtccggtcggttaccgggcggggtaacggaaccgtacgcggtaccgtaccggtccgtaacgtaaccgaccggacccgaccgggtaccgtccccgttcccgttcccggttcctaaccttcccggttaacccttccccgacccttacccgtaacccgttcgtaaccg

SEQ ID NO: 336740 - DNA, 752 bp, Homo sapiens
  misc_feature: GZ8MTXP01CRDMQ.22.30.C08.1.454.CMB.2.raw
  modified_base (189)..(189): a, c, t, g, unknown or other
  misc_feature (189)..(189): n is a, c, g, or t
  modified_base (300)..(300): a, c, t, g, unknown or other
  misc_feature (300)..(300): n is a, c, g, or t
tcagacatacgcgtcacgaccggtgctcgatttagtctgacgtcaaaaggggaaaggggagagctctgggggagtctgcaccatggcttggaccccactcctcttcctcaccctcctcctccactgcacagggtctctctccaggttgtactgactcaatccgcctctgcctctcgcctccgtgggacnccgtcggtcaacctcacctgtcgttcttagtacgtacaacacgtattactacaccgtcgcgtgcatacaaacaacgaggaccgggaagaacgggccctcgactacttaaangaagagttggactagttttggacagacccaccgaacggaacggggggtccggactcccgtgacgtccgtcgtttaccgccggggtcctaccgacggtccgtccggtccgggggcccggacgcccgtacccgtaccctacccgaccctaacgtccctacccgacggtcccctaccgaacgttacgtaagggaaaccgtagtacgggaacgggtcttaaggtaacctttaacgtttacgtacggtacgaacggacgtaacggtcgggggaaccgtcggggttcggggtcgttcggtcgggtcgtcgggtcgggacggggacggacgtaacgtcgtacggtaccgtcggtacggttccgcgaccggtaacggtcccgttcccggttcccccgttcgggtccctaccgtttccgttcccgttcccccttacccgttcccgttaaccggtaacccgg

SEQ ID NO: 336741 - DNA, 574 bp, Homo sapiens
  misc_feature: GZ8MTXP01AFNAU.22.30.C08.1.454.CMB.2.raw
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (427)..(427): a, c, t, g, unknown or other
  misc_feature (427)..(427): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctacttangaagnttggctagtttggcagccacgacgaagggggtcggactccgtgactcgctttcgtcgggctccgagcgtcgtcggggccgagcgcctaccgtcaccntctcccgacncctcagtctgaagagtgagtctagacttattacngtacagactagtgggaccgcggtggtcgtcgtaggcgtggtcggcggaggacctagctcggaacccgtcgtacggttcacgacccgaggtccttccggccccttcggtcctacgtcctacccgtccccttaccctccgaacgtcccg

SEQ ID NO: 336742 - DNA, 617 bp, Homo sapiens
  misc_feature: GZ8MTXP01EE56Q.22.30.C08.1.454.CMB.2.raw
  modified_base (165)..(165): a, c, t, g, unknown or other
  misc_feature (165)..(165): n is a, c, g, or t
  modified_base (185)..(185): a, c, t, g, unknown or other
  misc_feature (185)..(185): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctntgcctctgcctcctgggacncctcggtcaacctcacctgcgtttctagtagtcaacacgattacacacgtgcgtgcatcaacacnggccgagaggccctcgctactaangaagatggactatttggcagccaaccacgaagggggtcggactccctgactcgctttcncgggctcagctcgtcgggccagcgctacctcacntctcacgcctcatctagacatgagctgactattacgtgtacagacgaagtggggcgtcgggcggtccgtcgtggcgttggttcgggcgggaaccggggacaaaccggtcgtaacggcccggttaaaccggttcggttaccgaacggccccgaaagggtccccgttaccggttccccccgttacgggtttcccaaacccttccggttaacccttacccccgttaccccgtttaacccttccggtaacccgg

SEQ ID NO: 336743 - DNA, 584 bp, Homo sapiens
  misc_feature: GZ8MTXP01EIPYU.22.30.C08.1.454.CMB.2.raw
  modified_base (249)..(249): a, c, t, g, unknown or other
  misc_feature (249)..(249): n is a, c, g, or t
  modified_base (377)..(377): a, c, t, g, unknown or other
  misc_feature (377)..(377): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacacgtcgcgtgcatcaanaacagccggagaaggccctgctacttaaatgaaagattggcctaatttttggagccaccacaaagggggtcggatcccctgatcgcttctcgggctccagctctgtggccgagcgctaacctcaaccntctaccaaacctccagtctgaagatgagctgactattatagtanaganagtaggacgcgtcggggcgtcgtcggtcgtcgttcggtcgggacgggaaccgaacgtacgtacgtaccgtccgtaacggtacgacgacccgaacggtaccgtccgccccgttcccggttccgtaactctcgttcccctccccttccctccgaaccgtcg

SEQ ID NO: 336744 - DNA, 647 bp, Homo sapiens
  misc_feature: GZ8MTXP01DWGVP.22.30.C08.1.454.CMB.2.raw
  modified_base (382)..(382): a, c, t, g, unknown or other
  misc_feature (382)..(382): n is a, c, g, or t
  modified_base (439)..(439): a, c, t, g, unknown or other
  misc_feature (439)..(439): n is a, c, g, or t
tcagacatacgcgtcacgaccggtgctcgatttagtctgacgtcaaagggaaaggggagagctctgggggagtctgcaccatgggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtggcatcaacaacagccggagaagggccctcgctactaatgaagattggccatttggcagccaccacgaagggggtcggactcccgtgactcgctttcgtcgggctccagctcgtcggggccgagcgctacctcaccntctccagcctcagtctgaagatgaggctgactagttactggtcagacagtagggacncggtgggcgttcgtggcgtggttcgggcggggtaaacgggacccgaaaggtcgtacggtacccggttccgttacgggttaccaacgggttaccccgaaacggggtcccttcccgggttcccccccgttacggggtttcccaaaccccgtttccctttccgggtttcccccccttaacccccgtttccccttaaccggttaaccccggg

SEQ ID NO: 336745 - DNA, 596 bp, Homo sapiens
  misc_feature: GZ8MTXP01EG015.22.30.C08.1.454.CMB.2.raw
  modified_base (184)..(184): a, c, t, g, unknown or other
  misc_feature (184)..(184): n is a, c, g, or t
  modified_base (280)..(280): a, c, t, g, unknown or other
  misc_feature (280)..(280): n is a, c, g, or t
  modified_base (372)..(372): a, c, t, g, unknown or other
  misc_feature (372)..(372): n is a, c, g, or t
  modified_base (440)..(440): a, c, t, g, unknown or other
  misc_feature (440)..(440): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgcctctgcctctgcctccctgggancctcggtcaacctcacctgcgttcttagtagtcaacacgattacacaccgtcgcgtggcatcaaacaacagccggagaacggccctcgctactaangaagattggccatttggcagccaccacgaaggggtcggatccctgatcgcttcgcggctccagctcgtcggggccagcgctacctcaccctntccgtccacgccctccagtctagaagtatgacggctgaacttattactgtacagtacagtacgggacncggtcggcgtcgtcggcgttggttccgggcggaacggggacccaaggtcctcggacccgtcccgtaaggttccaaacgttcccgaaacgggtccttccggcccccgttggtccaccgttccgtaccgttccccttaccctccttaaccgtaaccgg

SEQ ID NO: 336746 - DNA, 608 bp, Homo sapiens
  misc_feature: GZ8MTXP01EZFEZ.22.30.C08.1.454.CMB.2.raw
  modified_base (185)..(185): a, c, t, g, unknown or other
  misc_feature (185)..(185): n is a, c, g, or t
  modified_base (393)..(393): a, c, t, g, unknown or other
  misc_feature (393)..(393): n is a, c, g, or t
  modified_base (455)..(455): a, c, t, g, unknown or other
  misc_feature (455)..(455): n is a, c, g, or t
  modified_base (507)..(507): a, c, t, g, unknown or other
  misc_feature (507)..(507): n is a, c, g, or t
tcagacatacgcgtcacgaccggtgctcgatttagtctgacgtcaaagggaaagtggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgatttacacaccgtcgcgtggcatcaacacagccggagaagggccctcgctactaatgaagattggcctagttttcggcagcccaccgacgaagggggtcggactcccgtgactccgctttcgtcggggactccgagcgtccggtcggggccgagccgactaaaccctcnccctacgtcctcccacgtccctaccgagttcctgaagatggaggctagtaactagtttaccnggtacacgacagtgggacggtcgtggtccgtcgtggtcgtgttcggacgggnggtaacccgaaggtcctggtaaccgtcgttaggtcaccgaccaacgggcgttccggaccccctggtccaactccgtcttcccctaacccttccgtaacccg

SEQ ID NO: 336747 - DNA, 550 bp, Homo sapiens
  misc_feature: GZ8MTXP01AOAY4.22.30.C08.1.454.CMB.2.raw
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (451)..(451): a, c, t, g, unknown or other
  misc_feature (451)..(451): n is a, c, g, or t
  modified_base (486)..(486): a, c, t, g, unknown or other
  misc_feature (486)..(486): n is a, c, g, or t
tcagacatacgcgtcacgaccggtgctcgatttagtctgacgtcaaagggaaaggggagagctctggggagtctgcaccatggcttggaccccactcctcttcctcacccctcctcctccactgcacagggtctctctcccaggttgtactgactcaatcgccctntgcctctgcctccctgggancctcggtcaacctcacctgcgttcttagtagtcaaacacgattactacaccgtcgcgtgcatcaacacngccggagaaggcctgctataangagatggcagtttgcagccacacgaaggggtcggactccgtgactcgcttctcgggctcagctcgtccggggccgagcgtcctacctcaccaatcctcccacgtcctccgacgtctacgaagatggaggtcctaggtacttattactgtcagacagtcgggacgcgtggcgtcngggctggtcggcggtaggacctagctcgccgtcgngttcacgccgagtccttcgccccttacggtctaccgtctccgtcccttaccctcgttccgaacg

SEQ ID NO: 336748 - DNA, 665 bp, Homo sapiens
  misc_feature: GZ8MTXP01ADPSI.22.30.C08.1.454.CMB.2.raw
  modified_base (187)..(187): a, c, t, g, unknown or other
  misc_feature (187)..(187): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (635)..(635): a, c, t, g, unknown or other
  misc_feature (635)..(635): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacncctcggtcaacctcacctgcgttcttagtagtcaacacgtattactacaccgtcgcgtggcatcaacaacngccggagaacggccctcgctactaangaagnttggcctagtttggcagccaccacgaagggggtcggactccctagatcgcttcgtcggggctcgagcgtcgtcggggccagccgcctaccgtccaccaactcctcccacggcccctaccgagttccgtagaaacgtagtacggacgggtacctaggtaactttaactttaccgtacggttaccgaaggaacccgtaaggttacggggaaccggtcgggtcggggtccggttcggtcgggtcggttcggttccggggacgggtaacggggaacctaaggtccgtcggtacccggtccgtacgggttccaccggttaccgaacggtccttcccgcccgttcgtaaccncgtctccgtcccacctccgttcgtaacccg

SEQ ID NO: 336749 - DNA, 692 bp, Homo sapiens
  misc_feature: GZ8MTXP01EPDF9.22.30.C08.1.454.CMB.2.raw
  modified_base (165)..(165): a, c, t, g, unknown or other
  misc_feature (165)..(165): n is a, c, g, or t
  modified_base (186)..(186): a, c, t, g, unknown or other
  misc_feature (186)..(186): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctntgcctctgcctccctgggacncctcggtcaacctcacctgcgttcttagtagtcaacacgattactacaccgtgcgtggcatcaaacaacaggccggaagaagggccctgctaactaatgaagattggcctatttggcagccaacacgaagggggtccggaactccgagactcgtctcgtcggctacgcgtcgtcggtccggggaccacgccgacctacccgtaaccaacctaactccctaccgacgtcccctacgtacgttacgagaagtagtaggacggtcgtacggtaacttaacgttacgttacggtacaacgacgtaggtaacgggtccggcggggtcggtcgttccggtggttccgttccgggttccggggtacgggaacggaaccggacgtaccggtaccggtacccggttaaccggtacgttacggaacccgacccggtaaacggtcccgttacccgttccccgttccggtaacctaccgtccgttcccgtccccgttccctaacccgttcgtaaccgg

SEQ ID NO: 336750 - DNA, 626 bp, Homo sapiens
  misc_feature: GZ8MTXP01CDVQA.22.30.C08.1.454.CMB.2.raw
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (336)..(336): a, c, t, g, unknown or other
  misc_feature (336)..(336): n is a, c, g, or t
  modified_base (396)..(396): a, c, t, g, unknown or other
  misc_feature (396)..(396): n is a, c, g, or t
tcagacatacgcgtcacgaccggtgctcgatttagtctgacgtcaaagggaaaggggagagctctggggagtctgcaccatggattggaccccactcctcttcctcaccctcctcctccactgcacagggtctctctcccaggttgtactgactcaatcgccctctgcctctgcctcccgtgggagcctcggtcaacctcacctgcgttcttagtagtcaaacacgtattacctacaccgtcgcgtgcatcaacaanagccggagaacggccctcgactactaagngaagatggcctagtttggcagccaccgacgaacgggggtcggactcccgngactccgtcttcgccggctccgagcgtcgtcggggccgaggccgtccgtacctcaacccntcctccacgtccctaccacgtctagaacgtagtggacggtctacggaacttaacttaacgtgtaccaagacgagtcgggacgtcggtggaccgtcgtgggcgttcgggtcgggacgggaacggtaaccgaaacgtcgtacccgtcggtaacggtacacggcccgaacgccgtcccgccccgttcgttcctaacgtcccttccggttccccacccgttcctcccgcgtccg

SEQ ID NO: 336751 - DNA, 528 bp, Homo sapiens
  misc_feature: GZ8MTXP02GXNWX.22.30.C08.1.454.CMB.2.raw
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
  modified_base (522)..(522): a, c, t, g, unknown or other
  misc_feature (522)..(522): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctcgctacttaatgaagattggccatttggcagccaccacgaagggggtcggatcccngatcgcttctcgggctccagctcgtcggggccgagcgctacctcaccntcctccagcctccagtctgaagntgagctgactatactgtcagtacagtgggacngtggcgtcgtgggctggtcggcggaggaccagctgacccgtcgtaggtcacgcccgaaggcctcggccccctggccactcgtcgtcccgcctcncgtacg

SEQ ID NO: 336752 - DNA, 511 bp, Homo sapiens
  misc_feature: GZ8MTXP02F26E9.22.30.C08.1.454.CMB.2.raw
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtgcgtggcatcaacacagccggagaaggccctgctactaatgagatggccatttggcagccaccacaaggggtcggatccctgatcgcttctcgggctccagctctggggccagcgctacctcaccntctccagccctcagtctgaagntgagctgactattacngtcagacagtgggacnctggctgtggctcgttggcggtagggaccaagctgaccgtctaggtcacgtcccaaggcctcgcccctggcacgtctcgtcccgcctccncncg

SEQ ID NO: 336753 - DNA, 544 bp, Homo sapiens
  misc_feature: GZ8MTXP02G7AE7.22.30.C08.1.454.CMB.2.raw
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctgctactaatgaagattggcatttggcagccaccagaagggggtcggatccctgactcgcttctcgggctccgagctctcggagccgagccgctacctcaccatcctccacgccctccagttcctagaagatgaggctgactattacngtacagacagtgggacncgtgggcgttcgtgggcttgggttcgggcgggaggggaccaagctaggacccgtcgtaggtccagcccgaggcctcgccccctggcaccttctcgtccccacccgtctccg

SEQ ID NO: 336754 - DNA, 539 bp, Homo sapiens
  misc_feature: GZ8MTXP02I403X.22.30.C08.1.454.CMB.2.raw
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (490)..(490): a, c, t, g, unknown or other
  misc_feature (490)..(490): n is a, c, g, or t
  modified_base (515)..(515): a, c, t, g, unknown or other
  misc_feature (515)..(515): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaagggccctcgctacttaatgaagattggccatttggcagccaccacgaaggggtcggatccctgatcgcttcncgggctccagctcgtcggggccgagcgctacctccaccntctccagccctccagtctgaacgatgaggctgacttatactgtcagacngtgggacncgtggcgtcgtgggtcctggttcgggcggaggggacccaggctgacccgtcgtaggtcncgccaacggctcgccccgtggtccncgtctcgtcccgcctcctcgaccg

SEQ ID NO: 336755 - DNA, 536 bp, Homo sapiens
  misc_feature: GZ8MTXP02H2VP1.22.30.C08.1.454.CMB.2.raw
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (512)..(512): a, c, t, g, unknown or other
  misc_feature (512)..(512): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagcaccacaagggggtcggatcccngatcgnttctcgggctccagctcgtcggggccgagcgctaccgtcaccntctccacgccctccaggtcctgaacatgaggctagactattacngtacagcagtgggacgntggcgtcgnggcgtgttcggcggagggacaagctcgaccgtcgaagtcacgccgaaaggcctcgcccctggtaacccncgtcgtccgtcccgccctctcgcg

SEQ ID NO: 336756 - DNA, 554 bp, Homo sapiens
  misc_feature: GZ8MTXP02GXAUW.22.30.C08.1.454.CMB.2.raw
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaatgaagattggccattttggcagccaccacaagggggtcggatccctgatcgcttctcgggctccagctcgtcggggccgagccgctaccctcaccntcctccacgccctccagtcctgaagatgaggctgactatactgtcagacagtggggacncgtgggcgtcgtgggctggttcggcgggagggaccaggccgtgaaccgtcctagggtcacggacccaaggcctccgcccccgtcggtccacgtcctcgttccccacccttccgtcaccgg

SEQ ID NO: 336757 - DNA, 517 bp, Homo sapiens
  misc_feature: GZ8MTXP02F4HZ9.22.30.C08.1.454.CMB.2.raw
  modified_base (369)..(369): a, c, t, g, unknown or other
  misc_feature (369)..(369): n is a, c, g, or t
  modified_base (423)..(423): a, c, t, g, unknown or other
  misc_feature (423)..(423): n is a, c, g, or t
  modified_base (511)..(511): a, c, t, g, unknown or other
  misc_feature (511)..(511): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaagggccctgctacttaatgaagattggccattttggcagccaccacaaggggtcggatccctgatcgcttctcgggctccagctctggggccagcgctacctcaccntctccagccctccagtctgaagatgaggctgactatactgtcagacatgggacnctggcgtctgggctgttcggcggagggaccagcgtgaccgtcgtaggtcacgccaaggctcgcccctggcactctcgtcccacctccnctaccg

SEQ ID NO: 336758 - DNA, 521 bp, Homo sapiens
  misc_feature: GZ8MTXP02J3T3S.22.30.C08.1.454.CMB.2.raw
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaagggccctcgctactaatgaagattggccatttggcagccaccacaaggggtcggatccctgatcgcttctcgggctccagctctggggccgagcgctacctcaccntctccagcctccagtctgagatgagctgactattactgtcagacatgggacnctggcgtctgggctgttcggcggagggaccagctgaccgtcctaggtcagccccaaggcctcgccccctggtcactctcgttccccaccctcctcacg

SEQ ID NO: 336759 - DNA, 515 bp, Homo sapiens
  misc_feature: GZ8MTXP02GUA98.22.30.C08.1.454.CMB.2.raw
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
tcagacatacgcgtcacgaccggtgctcgatttagtctgacgtcaaatggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccatttggcagccacacgaaggggtcggatccctgatcgcttctcgggctccagctccgtggggccagcgctacctcnccatctccagccctcagtctgaagatgaggctgactattactgtcagacagtgggacnctggctctggctgtcggcggaggaccaagctgaccgtcgaggtcagcccaaggcctgccccctggtcacgtctcgttccccacctctccg

SEQ ID NO: 336760 - DNA, 518 bp, Homo sapiens
  misc_feature: GZ8MTXP02JFDE3.22.30.C08.1.454.CMB.2.raw
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (496)..(496): a, c, t, g, unknown or other
  misc_feature (496)..(496): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaagggccctcgctactaatgaagattggccattttggcagccaccacaaggggtcggatccctgatcgcttctcgggctccagctctggggccagcgctacctcaccntctccagccctccagtctgaagntgaggctgactatactgtcagacatgggacnctggctctgggctggttcggcggagggaccagctgaccgtcctaggtcacgcccgaaggcctcgcccctgccnctctcgtcccaccctctcaccg

SEQ ID NO: 336761 - DNA, 526 bp, Homo sapiens
  misc_feature: GZ8MTXP02F5VEU.22.30.C08.1.454.CMB.2.raw
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (428)..(428): a, c, t, g, unknown or other
  misc_feature (428)..(428): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggcagccacacaaggggtcggatccctgatcgcttctcggggctccagctcgtcggggccagcgctacctcaccntcctccagccctccagtctgaaagntgagctgactatactgtcagacagtgggacncgtggcgtctgggctggtcggcggagggaccaagctgaccgtctaggtcacgcccaaggctcgccccctggtcactctcggttccccncctccncncg

SEQ ID NO: 336762 - DNA, 568 bp, Homo sapiens
  misc_feature: GZ8MTXP02JJ6EB.22.30.C08.1.454.CMB.2.raw
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcggatccctgatcgcttcgtcggctccagctcgtcggggccgagcgctacctcaccntctccagcctcagtctgaagntgagctgactattacngtcagacatgggacncgtggcgtcgtgggacttggttcggcggaggggacccaaggctcgacccggttcctaggggtccacggcccccaaaggggtcctccggccccccgttcgggccaccgttcctccgttccccctaccctcctccaacccgg

SEQ ID NO: 336763 - DNA, 528 bp, Homo sapiens
  misc_feature: GZ8MTXP02HA7L1.22.30.C08.1.454.CMB.2.raw
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
  modified_base (522)..(522): a, c, t, g, unknown or other
  misc_feature (522)..(522): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctcgctacttaatgaagattggccatttggcagccacacgaaggggtcggatccctgatcgcttctcgggctccagctcgtcggggccagcgctacctcaccntccnccagccctccagtctagaagatgaggctgactatactgtcagacagtgggacnctggcgtgtgggctggttcggcggtagggaccaagctgaccgtctaggtcagcccaaggcctcgccccctggtccactcctcgtccccgcctccnctaccg

SEQ ID NO: 336764 - DNA, 534 bp, Homo sapiens
  misc_feature: GZ8MTXP02G4N5C.22.30.C08.1.454.CMB.2.raw
  modified_base (329)..(329): a, c, t, g, unknown or other
  misc_feature (329)..(329): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaaagattggcctatttggcagccaccacgaagggggtcggatcccngatcgcttcgtcgggctccgagctcgtggggccagcgctaccncaccntctccagccctcagtctgaagntgagctagactatacngtcagacngtgggacncgtgggcgtcgtgggcttaggtcgggcggagggaccagcgtagaccgtctaggtcacggcccaaggcctcgccccctggccacgtctcgtcccacctctcacg

SEQ ID NO: 336765 - DNA, 522 bp, Homo sapiens
  misc_feature: GZ8MTXP02HDRD4.22.30.C08.1.454.CMB.2.raw
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctatctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggcagccaccacgaaggggtcggatccctgatcgcttctcgggctccagctcgtcggggccgagcgctacctcaccntctccagccctccagtctgaanatgagntgactattacngtcagacagtggacntggcgtcgtggctgttcggcggaggaccaagcgtgaccgtcaggtcacgcccaaggcctcgccccctggtccactctcgtcccaccctctcacg

SEQ ID NO: 336766 - DNA, 522 bp, Homo sapiens
  misc_feature: GZ8MTXP02JGE56.22.30.C08.1.454.CMB.2.raw
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (429)..(429): a, c, t, g, unknown or other
  misc_feature (429)..(429): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccattttggcagccaccacgaaggggtcggatccctgatcgcttctcgggctccagctcgtcggggccgagcgctacctcaccntctccagccctccagtctgaagntgagctgactatactgtcagacagtcgggacncgtggcgtctgggctggttcggcggtagggaccaaggctgaccgtctaggcacgccaaggctcgccccctgcactctcgtcccacctctcacg

SEQ ID NO: 336767 - DNA, 580 bp, Homo sapiens
  misc_feature: GZ8MTXP02HXWCU.22.30.C08.1.454.CMB.2.raw
  modified_base (372)..(372): a, c, t, g, unknown or other
  misc_feature (372)..(372): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccattttggcagccaccacaaggggtcggatcccctgatcgcttctcgggctccagctctggggccgagcgctacgtcaccntctcagcctccagtctgagatgaggctgactattactgtacagacagttagggacgtcgtgggtcgtccgtggggccttgggttccgggacgggaggggaacccaaggccgttacggacccgttccgtagggttccacggacccgaaaggccttaccgcccccttggccctaactcgttccgttccccaccccttccttaccgcccgg

SEQ ID NO: 336768 - DNA, 545 bp, Homo sapiens
  misc_feature: GZ8MTXP02JLX4B.22.30.C08.1.454.CMB.2.raw
  modified_base (374)..(374): a, c, t, g, unknown or other
  misc_feature (374)..(374): n is a, c, g, or t
tcagacatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaaggggtcggatccctgatcgcttcgtcgggctccagctcgtcggggccagcgctacctcaccntctccagccctcagtctgaagatgagctgactattactgtacagacagtgggacgcgtggcgtcgtgggcttggttcgggcggtagggacccaaggcgtcgacccgttccgtaggtcacgcccgaaggcctcgccccctggtccactccgtcgtccccacccgtctcaccg

SEQ ID NO: 336769 - DNA, 529 bp, Homo sapiens
  misc_feature: GZ8MTXP02GJSLS.22.30.C08.1.454.CMB.2.raw
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
  modified_base (456)..(456): a, c, t, g, unknown or other
  misc_feature (456)..(456): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctgctacttaatgaagattggcctatttggcagccacacgaaggggtcggatccctgatcgcttcgtcgggctccagctcgtcggggccgagcgctacctcaccntcctccacgccctccagtctgaagntgagctgactattactgtcagacagtggggacncgtgggcgtgtgggtctggtcggngggacggaccagctgaccgtcagggtcacgccaggctccgcccctggtccactctcgtcccacctcctacacg

SEQ ID NO: 336770 - DNA, 645 bp, Homo sapiens
  misc_feature: GZ8MTXP02HC2F8.22.30.C08.1.454.CMB.2.raw
  modified_base (373)..(373): a, c, t, g, unknown or other
  misc_feature (373)..(373): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaatgaagattggctatttggcagccaccacgaaggggtcggatccctgatcgcttctcgggctccgagctcgtcggggccgagcgctacctcaccntcctccacgccctccgacgtctagaaagagtgaggctgaacttattactgtacaagacagtagggacgtcgtgggtcgtcgtgggtaccttgggttccggacggggaagggaaccccgaaaggtccgttacggaaccccggttccgtaaacggggttccaaccggacccgaaacggggccctacccggtccccccgttccggggtaacccgaaaccgtttcccttaccggtttccccccaacccccggtttccctttacccgtaaccccggg

SEQ ID NO: 336771 - DNA, 575 bp, Homo sapiens
  misc_feature: GZ8MTXP02JOWFR.22.30.C08.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (372)..(372): a, c, t, g, unknown or other
  misc_feature (372)..(372): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattacacaccgtcgcgtggcatcaacaacagccggagaaggccctcgctactangaanatgctatttggcagccacacgaaggggtcggatcccgtgactcgcttcgtcgggctccgagctcgtcggggccgagcgctacctcaccnctcctccacgccctccagtcctagaaagatggagctgaacttatactgtacagacagtaggggactcgtggcgtcgtgggtctaggttcggcgggtagggaccaggcgtacgaccgtcgtaggtccacggcccgaacggccgtccgtcccccgtcggtcctacccgtcgttcccgttccccaccccgttccgtacgtacccgg

SEQ ID NO: 336772 - DNA, 532 bp, Homo sapiens
  misc_feature: GZ8MTXP02GQWQ6.22.30.C08.1.454.CMB.2.raw
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccacacgaaggggtcggatccctgatcgcttcgtcgggctccagctcgtcggggccgagcgctacctcaccntctccagcctccagtctgaantgagctgactattactgtacagacagtgggacncgtggcgtcgtgggctggttcgggcggaggacagcgtgaccgtcgtaggtcacgcccgaagcctcgccccctggccacgtcgtcgttccccgccctcctctaccg

SEQ ID NO: 336773 - DNA, 627 bp, Homo sapiens
  misc_feature: GZ8MTXP02G9KNX.22.30.C08.1.454.CMB.2.raw
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgcctctgcctctgcctccctgggagcctcggtcaacctcacctgcgttcttagtagtcaacacgattactacaccgtcgcgtggcatcaaacaacaggccggagaagggccctcgctacttaatgaagattggcctatttggcagccaccacgaaggggtcggactcccgtgatcgcttcgtcgggctccagctcgtcggggccgagcgctacctcaccntcctccacgcctccagtctagaacgntggacgctgacttattacngtacagacagtacggggactcgtcggtcgtcgtgggccttgggttccgggacgggacgggaccgaaggtccgtacgtacccggttaccgtacgggttaccgacggtaccccgaacgggcccgtacccggtccccccttacggggttccctacccggttcccgttcccggttcccccgtcccccttacccgtccgtaccccggg

SEQ ID NO: 336774 - DNA, 532 bp, Homo sapiens
  misc_feature: GZ8MTXP02JT6BZ.22.30.C08.1.454.CMB.2.raw
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgcctctgcctctgcctccctgggagcctcggtcaacctcacctgcgttcttagtagtcaacacgattactacaccgtcgcgtggcatcaacaacagccggagaagggccctcgctactaatgaagattggccatttggcagccaccacgaagggggtcggatccctgatcgcttcncgggctccagctcgtcggggccagcgctacctcaccntcctccacgcctccagtctgaaagntgagctgactattactgtacagacagtgggacncgtggctgtgggctggtcggcggagggaccagcgtgacccgtcgtaggtcacggcccaaggctccgccccctggtcactcgtcgtccccaccctcctacacg

SEQ ID NO: 336775 - DNA, 545 bp, Homo sapiens
  misc_feature: GZ8MTXP02GWG6J.22.30.C08.1.454.CMB.2.raw
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaatgaagattggccatttggcagccacacgaaggggtcggatccctgatcgcttcgcgggctccagctcgtcggggccagcgctacctcaccntcctccacgccctccagtctacgaaagntggaggctgactatacngtcagacngtgggacnctgggctcgtggctggtcggcggagggaccaagcgtacgaccgtcgtacggtcaacgcccaaaggcctcgcccccgtggtccacgtccttacgtcccccaccctcctacgaccg

SEQ ID NO: 336776 - DNA, 542 bp, Homo sapiens
  misc_feature: GZ8MTXP02JX2VA.22.30.C08.1.454.CMB.2.raw
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (429)..(429): a, c, t, g, unknown or other
  misc_feature (429)..(429): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccattttggcagccaccacgaaggggtcggatcccgtgatcgcttctcgggctccagctcgtggggccgagcgctaccgtcaccntccnccacgcctccagtctgaagatgagctgactatctgtcagacagtgggacngtggctctgggctgttcggcgggtaggaccaaggctggaccgtcgtaggcacgcccgaaggcctccggcccccgtggtccacgttcctacgttcccccaccttccgactaccg

SEQ ID NO: 336777 - DNA, 554 bp, Homo sapiens
  misc_feature: GZ8MTXP02IRP7N.22.30.C08.1.454.CMB.2.raw
  modified_base (374)..(374): a, c, t, g, unknown or other
  misc_feature (374)..(374): n is a, c, g, or t
  modified_base (421)..(421): a, c, t, g, unknown or other
  misc_feature (421)..(421): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctactaatgaagattggcctatttggcagccacacgaaggggtcggatccctgatcgcttcgtcgggctccgagctcgtcggggccagcgctacctcacntctccacgccctaccagtcctagaaagatgaggctagacttattacngtacaagacagtggggactgaggcgtctgggcttggtcggcgggaaggtaccagctgacccgttcgtaggtccacgacccaaggcctaccgcccccgtggccacctcgtcgttcccccgcccttctaccacgg

SEQ ID NO: 336778 - DNA, 637 bp, Homo sapiens
  misc_feature: GZ8MTXP02J2N1A.22.30.C08.1.454.CMB.2.raw
  modified_base (185)..(185): a, c, t, g, unknown or other
  misc_feature (185)..(185): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
  modified_base (439)..(439): a, c, t, g, unknown or other
  misc_feature (439)..(439): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttctagtagtcaacacgattacacaccgtcgcgtgcatcaacaacagccggagaacgggccctgctactaangaagnttggcctatttggcagccaccacggaaggggtcggatccctgactcgcttcgcgggctccgagcgtcgtcggggccgagcgctacctcacnctcctccacgcctccagtctagaagatggaggtctaggacttagtctggtcagacagtggggacncgtggcgtgtgggtacgttgttccggggacggacgggacctaaacggccgtacggtaacccgttcccgtaaaggggttcccaacggtcccccgaaacgggtcccgtaccccggtcccccccggtttacgggtcccgtaacccgtttcccgttcccggttttcccccccgaaccccgtttccttaacccgtacccgggg

SEQ ID NO: 336779 - DNA, 554 bp, Homo sapiens
  misc_feature: GZ8MTXP02HW43I.22.30.C08.1.454.CMB.2.raw
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (429)..(429): a, c, t, g, unknown or other
  misc_feature (429)..(429): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaaagattggccatttggcagccaccacgaagggggtcggatccctgatcgcttcgtcgggctccgagctcgtcggggccagcgctacctcacntctccacgccctcagtctgaantgagctgacttatactgtcagacagtgggacncgtgggcgttcgtgggcttggtcgggcgggtagggacccaaggctacggacccgttcgtagggtcacggcccgaaggcctccgccccctggtccaccgttctccgttccccgccctccgtcgacg

SEQ ID NO: 336780 - DNA, 532 bp, Homo sapiens
  misc_feature: GZ8MTXP02F7ZPM.22.30.C08.1.454.CMB.2.raw
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
  modified_base (424)..(424): a, c, t, g, unknown or other
  misc_feature (424)..(424): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggcagccaccacgaaggggtcggatccctgatcgcttcncgggctcagctctggggccagcgctacctcaccntctccagccctccagtctgaagatgagctgactatactgtcagacagtgggacnctggcgtctgggctggttcggcggagggaccaaggctagaccgtcctaggtcacgcccgaacggcgtcgccccctggtccacgtctcgtccccaccctccgtctaccg

SEQ ID NO: 336781 - DNA, 534 bp, Homo sapiens
  misc_feature: GZ8MTXP02IDDK2.22.30.C08.1.454.CMB.2.raw
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgtttcttagtagtcaacacgattactacaccgtcgcgtggcatcaacaacagccggagaagggccctgctactaatgaagattggccatttggcagccacacgaaggggtcggatccctgatcgcttcgtcgggctccagctcgtcggggccgagcgctacctcaccntcctccacgccctccagtctagaagatgaggctagactattactgtacagacagtggggacnctgggcgtcngggctggtacggnggacggaccagcgtgacccgtcgtaggtcacgcccaacggcnccgcccctggcactctcgtaccccncctcncncg

SEQ ID NO: 336782 - DNA, 614 bp, Homo sapiens
  misc_feature: GZ8MTXP02JSY8Z.22.30.C08.1.454.CMB.2.raw
  modified_base (185)..(185): a, c, t, g, unknown or other
  misc_feature (185)..(185): n is a, c, g, or t
  modified_base (368)..(368): a, c, t, g, unknown or other
  misc_feature (368)..(368): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
tcagacatacgcgtcacgaccggtgctcgatttagtctgacgtcaaagggaaagggagagctctggggagtctgcaccatggcttgggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtgcgtgcatcaacacagccggagaaggccctcgctactaatgaagattggccatttggcagccacacgaaggggtcggatcccgtgactcgcttctcgggctccagctcgtcggggccagcgctacctcacntctcagcctccagtctgaacgatgagctgactatacngtcagacagtcggggcncgtggcgtcgttagggccttggttccgggcgggtaacggggacccaaaggtccgttcggaacccggttccgttaaaggggccaacggcccccgtaaaaggggcccttaccgggcccccccccgtttggggcctaacccggtttcccttaccggtttcccccccaacccccgtttcccgttaccccgtacccg

SEQ ID NO: 336783 - DNA, 520 bp, Homo sapiens
  misc_feature: GZ8MTXP02GBXCI.22.30.C08.1.454.CMB.2.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctggtcaacctcacctgcgttcttagtagtcaacacgattactacaccgtcgcgtggcatcaacaacagccggagaagggccctcgctacttaangaaagattggccatttggcagccaccacgaaggggtcggatcccngatcgcttcncgggctccagctcgtggggccagcgctacctcaccntctccagccctcagtctgaagatgagctgactatactgtcagacagtgggacnctggcgtcgtgggctggttcggcggagggaccaagctgaccgtctaggtcacgcccaaggctcgccccctgccactctcgtcccacctcctcacg

SEQ ID NO: 336784 - DNA, 514 bp, Homo sapiens
  misc_feature: GZ8MTXP02G4ZLF.22.30.C08.1.454.CMB.2.raw
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaatgaagattggcctatttggcagccaccacgaagggggtcggactccctgatcgcttcgtcgggctccagctcgtcggggccagcgctacctcacntctcagcctcagtctgaantgagctgaactattacngtcagacagtgggacncgtggcgtctgggctgtcggcgggaggaccagctgacctcgtaggcagccaaggctcgcccctgccactctcgtccccncctcncncg

SEQ ID NO: 336785 - DNA, 539 bp, Homo sapiens
  misc_feature: GZ8MTXP02JN3CP.22.30.C08.1.454.CMB.2.raw
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (531)..(531): a, c, t, g, unknown or other
  misc_feature (531)..(531): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccacacaagggggtcggatccctgatcgcttctcgggctccgagctcgtcggggccgagcgctacctcaccntctccagccctccagtctgaagntgaggctgactatacngtcagacagtgggacncgtggcgtctgggcttggttcgggcggtagggaccagctgaccgtcgtaggtcacgcccgaaggcctcgccccctggtcacctcgtcgttccccgcccttccncgtaccgg

SEQ ID NO: 336786 - DNA, 545 bp, Homo sapiens
  misc_feature: GZ8MTXP02I3PBR.22.30.C08.1.454.CMB.2.raw
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaaggggtcggatccctgatcgcttctcgggctcagctcgtcggggccagcgctaccncaccntctccagccctcagtctgaagntgaggctgactattactgtcagacagtgggacncgtggcgtcgtgggtctggttccgggcgggtacgggaccaagcctcggaacccgtcgtacggtcacgcccgaaggcctcgcccccgtggtccactctcgtccccgcctccgtcaccg

SEQ ID NO: 336787 - DNA, 559 bp, Homo sapiens
  misc_feature: GZ8MTXP02IAUZD.22.30.C08.1.454.CMB.2.raw
  modified_base (418)..(418): a, c, t, g, unknown or other
  misc_feature (418)..(418): n is a, c, g, or t
  modified_base (443)..(443): a, c, t, g, unknown or other
  misc_feature (443)..(443): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgcctctgcctctgcctccctgggagcctcggtcaacctcacctgcgttcttagtagtcaacacgattactacaccgtcgcgtggcatcaacaacagccggagaacggccctcgctactaatgaagattggcatttggaagccacacgaaaggggtcggatccctgactcgctttcgcgggctccagctcgtggggccccagccgctacctcaccatcctccacgccctccagtctagaagatgaggctagactattacngtcagacagtgggacgctggcgtgnggctgttcgggcggaggacccaaggcttgacccgtccgtaggccgacgacccaagggcctcgcccccttggacctaaccgtccgtccgttcccccaccttccctaccgtacgtccg

SEQ ID NO: 336788 - DNA, 554 bp, Homo sapiens
  misc_feature: GZ8MTXP02F2JLX.22.30.C08.1.454.CMB.2.raw
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
tcagacatacgcgtcacgaccggtgctcgatttagtctgacgtcaaagggaaaggggagagctctggggagtctgcaccatggcttggaccccactcctcttcctcaccctcctcctacactgcacagggtctctctcccaggttgtactgactcaatcgccctctgcctctgcctccctgggagcctcggtcaacctcacctgcgttcttagtagtcaacacgattacctacaccgtcgcgtggcatcaacaacagccggagaacggccctcgctactaatgaagattggcctagtttggcagccaccacgaaggggtcggatcccngatcgctctcgggctccagctcgtcggggccacgcgctacctcaccntctccagccctcagtctagaagntgagctgactatctgtcagacngtcgggacgtcgtggcgtcgtggcgtcggttcgggcggtacgggacagcgtcgacccgtcgtaggtcacgaccgaaggtcccgtcgcccccgtaggcctaccgtccgtccgtccccaccccgtcctacgtaccg

SEQ ID NO: 336789 - DNA, 617 bp, Homo sapiens
  misc_feature: GZ8MTXP02HELKN.22.30.C08.1.454.CMB.2.raw
  modified_base (378)..(378): a, c, t, g, unknown or other
  misc_feature (378)..(378): n is a, c, g, or t
  modified_base (403)..(403): a, c, t, g, unknown or other
  misc_feature (403)..(403): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccattttggcagccaccacgaagggggtcggatcccgtgatcgcttcgtcgggctccagctcgtcggggccgagcgctaccgtcaccntcctccacgcctccagtctagaagntgaggctgacttattactgtacagacagtcggggacgtcgtgggtcgtcgtcgggcgttgggttccgggcgggaacggggaccgaaggccgtcggacccggttccgtacgggtaccgacggacccgtaaacggcccgtaccggcccccccgttcggggtaacccgtaccttccgttcccgttacccccacccccttcccgtaccgtaaccccgg

SEQ ID NO: 336790 - DNA, 541 bp, Homo sapiens
  misc_feature: GZ8MTXP02FYASY.22.30.C08.1.454.CMB.2.raw
  modified_base (283)..(283): a, c, t, g, unknown or other
  misc_feature (283)..(283): n is a, c, g, or t
  modified_base (379)..(379): a, c, t, g, unknown or other
  misc_feature (379)..(379): n is a, c, g, or t
  modified_base (442)..(442): a, c, t, g, unknown or other
  misc_feature (442)..(442): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagcccggagaagggccctcgctacttaangaagattggcctattttggcagccaccacgaaggggtcggatccctgatcgcttcgcgggctccagctcgtcggggccgagcgcctacctcgaccntcctccagccctccagtcctagaagatggacggctgacttattactgtcagacagtggggacnctgggctcgtgggcttgttcgggacggtacggaccagcgtcgaccgtcaggtcacgcccaagcctcgcccctggtcacgtctcgtcccacctcctcacg

SEQ ID NO: 336791 - DNA, 611 bp, Homo sapiens
  misc_feature: GZ8MTXP02HEHN2.22.30.C08.1.454.CMB.2.raw
  modified_base (323)..(323): a, c, t, g, unknown or other
  misc_feature (323)..(323): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctactaatgaagatggctatttggcagccaccagaaggggtcggatcccngatcgcttcgcgggctccgagctcgtcggggccaggccgctaccgtccacctctcctccacgccctccgacgtctagaacgatgagctagacttattactgtcagacgagtcggggacgtcgtggtccgtcgtgggtcgttggttcgggacgggacgggaacccgaaggctacggacccggttactacggggtccacggaccccgaaggccctaccggccccccgttcgggtaaccctccgttcccgttccggttaccccccaccccgttcccgtaccgttaacccgg

SEQ ID NO: 336792 - DNA, 511 bp, Homo sapiens
  misc_feature: GZ8MTXP02ITFO9.22.30.C08.1.454.CMB.2.raw
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggcccctcgctacttaatgaagattggcctatttggcagccacacaaggggtcggatccctgatcgcttcgtcggctcagctcgtcggggccagcgctacctcaccntctccagccctccagtctgaagntgagctgactattacngtcagacagtgggacntggcgtctggctgtcggnggaggacagctgaccgtcagtcacgccaggctcgcccctggcncgtctcgtcccgcctccacnccg

SEQ ID NO: 336793 - DNA, 534 bp, Homo sapiens
  misc_feature: GZ8MTXP02I8PZX.22.30.C08.1.454.CMB.2.raw
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (419)..(419): a, c, t, g, unknown or other
  misc_feature (419)..(419): n is a, c, g, or t
tcagacatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctcgctactatgaagattggccatttggcagccaccacaagggggtcggatccctgatcgcttctcgggctccagctctcggggccagcgctactcaccntctccagccctccagtctgaantgagctgacttatactgtcagacatgggacncgttggcgtctgggctgttcggcggagggaccaggctgacccgtctagggtcacgcccgaaggcctcgcccccgtggtccacgttcctcggttcccccgccctccgtacacccgg

SEQ ID NO: 336794 - DNA, 579 bp, Homo sapiens
  misc_feature: GZ8MTXP02JG9OX.22.30.C08.1.454.CMB.2.raw
  modified_base (334)..(334): a, c, t, g, unknown or other
  misc_feature (334)..(334): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactacaccgtcgcgtggcatcaacacagccggagaggccctcgctactaatgaaagatggccatttggcagccacacgaagggggtcggatcccgtgatcgcatcncgggctcagctcgtcggggccgagcgctaccgtcaccgactctccagccctcgacgtctagaacgatgaggctagacttattactagtccagactagtacgggacgtcgtgggtccgtcgtggcgttgggttccgggcgggtaacggaccgaaagcgtacgaccgtccgtaggtcgacgacccgtaacggcctccgccccgtcggtcctaccgttccgtccgtcccccggtccctcccgtacccg

SEQ ID NO: 336795 - DNA, 588 bp, Homo sapiens
  misc_feature: GZ8MTXP02JN2T3.22.30.C08.1.454.CMB.2.raw
  modified_base (186)..(186): a, c, t, g, unknown or other
  misc_feature (186)..(186): n is a, c, g, or t
  modified_base (382)..(382): a, c, t, g, unknown or other
  misc_feature (382)..(382): n is a, c, g, or t
  modified_base (550)..(550): a, c, t, g, unknown or other
  misc_feature (550)..(550): n is a, c, g, or t
  modified_base (569)..(569): a, c, t, g, unknown or other
  misc_feature (569)..(569): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacncctcggtcaacctcacctgcgttcttagtagtcaacacgattactacaccgtcgcgtggcatcaaacaacagccggagaacggccctcgctacttaatgaaagattggcctagttttcggcagccaccacgaagggggtcggatccctgactcgcttcgtcggctccagctcgcggggccgagcgctacctcaccnctcctccacgccctcagtctgaaagactgaggctgaacttattaccgtgtccaagacagtggggactcgtcgggcgtcgtgggctgggtccgggacggtacggggaccaggcgtacggaccgtccgtagggccaacgccccgaaggtccctccggccccctcggtccnccggttctccggtcccccncccttcccgtactacccgg

SEQ ID NO: 336796 - DNA, 527 bp, Homo sapiens
  misc_feature: GZ8MTXP02JZELO.22.30.C08.1.454.CMB.2.raw
  modified_base (334)..(334): a, c, t, g, unknown or other
  misc_feature (334)..(334): n is a, c, g, or t
  modified_base (372)..(372): a, c, t, g, unknown or other
  misc_feature (372)..(372): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagattggccatttggcagccacacgaaggggtcggatccctgatcgcttcncgggctccagctcgtcggggccgagcgctacctcaccntcctccagcctcagtctgaagatgaggctgactatactgtcagacagtgggacgctgggcgtctgggctggttcggcggagggaccaagctgaccgtctaggcacgcccaaggcctcgcccccgtgccactctcgttcccgccctacctcgaccg

SEQ ID NO: 336797 - DNA, 558 bp, Homo sapiens
  misc_feature: GZ8MTXP02G53X3.22.30.C08.1.454.CMB.2.raw
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
  modified_base (512)..(512): a, c, t, g, unknown or other
  misc_feature (512)..(512): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggcctattttggcagccaccagaaggggtcggatccctgatcgcttcgcggctccgagctcgtcggggccagccgctacctcaccntcctccacgccctccagtctagaagntggagctagactatactgtacagacagtgggacncgtggcgtcgtgggtctggttcggngggtacggaccaggtcgtaggacccgtcgtaggtcacggcccgaacggtccnccgtcccctggcctccttccgtcgttcccccgcctccgtcgtaccg

SEQ ID NO: 336798 - DNA, 769 bp, Homo sapiens
  misc_feature: GZ8MTXP02JBGUS.22.30.C08.1.454.CMB.2.raw
  modified_base (376)..(376): a, c, t, g, unknown or other
  misc_feature (376)..(376): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaatgaagattggcctattttggcagccaccacgaaggggtcggatcccgtgatcgcttcgtcgggctccagctcgtcggggccgagcgctacctcaccntcctccacgccctccgacgtcctaggaaacgtagtggaacgggtcttacggaaaccttaatttaccgtacggttacctaaacgggaacctaaggttacgggggaaaccgtccggttcgggggacccgtttccggttcgggggtcccgtttcggggtttcccgggggacccgggggtaacggggaacccccgtaaaagggtcccgttacgggaaacccccggtttcccggttaaacggggttacccgaaacgggtaccccccggaaaaggggtcccccgttacccgggacccccccccggtttcggggttaacccccaacccgtttccccggtttacccgggtttaccccccccggtccccccgtttaccccgtccccgtttaaacccccgggg

SEQ ID NO: 336799 - DNA, 616 bp, Homo sapiens
  misc_feature: GZ8MTXP02INB3B.22.30.C08.1.454.CMB.2.raw
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaaccctcacctgcgttcttagtagtcaacacgtattactacaccgtcgcgtggcatcaacaacagccggagaacggccctcgctactaatgaagatggcctagtttggcagccaccacggaaggggtcggactccctgactcgcttcgtcgggcctcagctcgtcggggccgagcgctctcaccntcctccacgccctccagtctgaaagctggaggctgacttattacngtacagactagtgggacncgtggtcgtcgtgggccttgggttcgggacgggaacggggaccaaaggccgtacgaaccccggttcgtaacgggtccgaacgaccccgaaggtcccgtccgtacccccccgttcgggtccctaaccgttcccgttacccggttcccccacccccgttcccgttaccgtaccccgg

SEQ ID NO: 336800 - DNA, 588 bp, Homo sapiens
  misc_feature: GZ8MTXP02I0YQS.22.30.C08.1.454.CMB.2.raw
  modified_base (393)..(393): a, c, t, g, unknown or other
  misc_feature (393)..(393): n is a, c, g, or t
  modified_base (426)..(426): a, c, t, g, unknown or other
  misc_feature (426)..(426): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtgcgtggcatcaacaacagccggagaaggccctcgctactatgaagatggcatttggctagccaccagaaggggtcggatccctgatcgcttctcgggctccagctcgtggggccagccgctacctcgaccagtcctccagccctccagtctgaagntgagctggatattactgtcagacatacgggacncgtggcgttcgtgggtccgtgttccgggacgggtacgggaccgtaagccgtcggaaccgtccgtagggtccgacggacccgaaaggtcctaccggtcccccccgtggggtaaccctaccgtccgtaccgttcccccggcccccgtttacctccctaacccgg

SEQ ID NO: 336801 - DNA, 540 bp, Homo sapiens
  misc_feature: GZ8MTXP02JTLMI.22.30.C08.1.454.CMB.2.raw
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaaatgaagattggccattttggcagccaccacgaagggggtcggatcccngactcgcttctcggggctccgagctctcggggccagcgctacctcaccatccnccacgcctccagtctgaacgatgagctgactatactgtcagacagtgggacncgtggcgtctgggctggttcggcgggagggaccaaggctgaccgtccaggtcacgcccaaaggcctcggccccctggtccactcgtcgtccccgcccttcgctacg

SEQ ID NO: 336802 - DNA, 669 bp, Homo sapiens
  misc_feature: GZ8MTXP02IRA52.22.30.C08.1.454.CMB.2.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggagcctcggtcaacctcacctgcgttcttagtagtcaacacgtattactacaccgtcgcgtggcatcaacacngcggagaggccncgctactatgaanatgcctatttggcagccaccacgaaggggtcggatccctgatcgcttcgtcggctccagctcgtcggggcccgagcgcgtacctccacccactccgtcccacgcccctacccgacgtaccttggaaacgtgtaggacggcgtagtaaaccttaactttaccgtagtacgtaacgacaggtcggggaacgtccgttacgggtcgttccgttgggtccgttcggtttaccgggacggggtaacgggaaccgtaaacgggccgtacggaaccccggttcgtaacgggttccgaacgaccccgtaaaggccctacccggtcccccgttcgggttaaccctcccgttccgtttcccggttcccccgtcccccttcccgtacccgttaacccgg

SEQ ID NO: 336803 - DNA, 521 bp, Homo sapiens
  misc_feature: GZ8MTXP02GLVSA.22.30.C08.1.454.CMB.2.raw
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggcagccaccacgaaggggtcggatccctgatcgcttctcgggctccagctcgtcggggccgagcgctacctcaccatcctccacgcctccagtctgaagntgagctgactattacngtcagacatgggacngtgggcgtcgtgggctggttcggcggtagggacaagctgaccgtcgaggtcagcccaaggctcgcccctgcactcncttcccgcctctcncg

SEQ ID NO: 336804 - DNA, 529 bp, Homo sapiens
  misc_feature: GZ8MTXP02JAU0Q.22.30.C08.1.454.CMB.2.raw
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccaccacaaggggtcggatccctgatcgcttctcgggctccagctcgtggggccgagcgctacctcaccntctccagccctccagtctgaagntgagctgactatacngtcagacatgggacncgtggcgtctgggctggttcggcggtaggggaccaaggctgacccgtcgtaggtcacggcccaaggcctacgccccctggcactctcgtccccaccgtcctcacg

SEQ ID NO: 336805 - DNA, 586 bp, Homo sapiens
  misc_feature: GZ8MTXP02GTCJX.22.30.C08.1.454.CMB.2.raw
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (567)..(567): a, c, t, g, unknown or other
  misc_feature (567)..(567): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctactaatgaagattggccatttggcagccaccacgaaggggtcggatccctgactcgcttcgtcggggctccgagctcgtcggggccgagcgctacctcaccntcctccacgccctcagtctgaagntggagtctgacgttataccgtgtacgacgactggtacggacgtcggtcggtcgtcggtggtcgttcggtcgggacgggacggacgacgtcgacgtccgtacgtacgtcgaccgaccggacgtccgtcccgtccccggtcgtcctacccgttcgttcccgttaccccncccgtcctaccgtacccgg

SEQ ID NO: 336806 - DNA, 538 bp, Homo sapiens
  misc_feature: GZ8MTXP02JEAS1.22.30.C08.1.454.CMB.2.raw
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctgctactatgaagattggccatttggcagccacacgaaggggtcggatccctgatcgcttcncgggctcagctcgtcggggccagcgctacctcaccntctccagccctcagtctgaagntgagctgactatactgtcagacagtcgggacncgtgggctcgtgggcttgggtcggcggacggaccagctgacccgtcgtaggtcacgtcccgaaggcctccgcccccgtggtccacgttccgtcgtccccncccttccnccgtaccgg

SEQ ID NO: 336807 - DNA, 607 bp, Homo sapiens
  misc_feature: GZ8MTXP02IRB4C.22.30.C08.1.454.CMB.2.raw
  modified_base (283)..(283): a, c, t, g, unknown or other
  misc_feature (283)..(283): n is a, c, g, or t
  modified_base (377)..(377): a, c, t, g, unknown or other
  misc_feature (377)..(377): n is a, c, g, or t
  modified_base (408)..(408): a, c, t, g, unknown or other
  misc_feature (408)..(408): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaaccctcacctgcgttcttagtagtcaaacacgattacacaccgtcgcgtggcatcaacaacagccggagaaggccctcgctacttaangaagatggcctatttggcagccacacgaaggggtcggatccctgactcgcttcgtcgggctccagctcgtcggggccgagccgctacctcaccntcctccacgccctccgagtcctagaaacgtntggaaggctagtaacttattacgtgtacaagacagttcggggacgtcgtgggccgttcgtgggtctgggttccgggcggggaaggaaccgaagtccgtacgacccggttcgtacggtccacggtacccgaacggcctcccggcccccgtggtcctaccgttccgttcccggtttccccgcccctttaccgtcgacccgg

SEQ ID NO: 336808 - DNA, 523 bp, Homo sapiens
  misc_feature: GZ8MTXP02IGZ03.22.30.C08.1.454.CMB.2.raw
  modified_base (333)..(333): a, c, t, g, unknown or other
  misc_feature (333)..(333): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccagttgtactgactcaatcgccctctgcctctgcctccctggagcctcggtcaacctcacctgcgttcttagtagtcaacacgattactacaccgtcgcgtggcatcaacaacagccggagaagggccctcgctacttaatgaaagattggccatttggcagccacacaaggggtcggatccctgatcgcttcncgggctccagctcgtggggccagcgctacctcnccntcctccagcctcagtctgaagatgagctgactattactgtcagacatgggacnctgggctcgtgggctggttcggcggagggaccaaggctgacctccgaggtcagccccaagtcncgccccctggccacgtcncgttccccgcccttcacncg

SEQ ID NO: 336809 - DNA, 614 bp, Homo sapiens
  misc_feature: GZ8MTXP02IW0I9.22.30.C08.1.454.CMB.2.raw
  modified_base (328)..(328): a, c, t, g, unknown or other
  misc_feature (328)..(328): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (595)..(595): a, c, t, g, unknown or other
  misc_feature (595)..(595): n is a, c, g, or t
tcagacatacgcgtcacgaccggtgctcgatttagtctgacgtcaaagggaaaggggagagctctggggagtctgcatcatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggccatttggcagccacacgaagggggtcggatcccgngacgtcgtctccgtcggcctacgcgtcctcggtcggggccgagccgtacctacctaccncctactccctaccgaccgtcccncgtacgtcgaagaatgtaggcgtntagtacttacgttacgtgacacgataggtaggcgcggtcgcgtgtcgcgttgggtcgggaggacggacgacggcgtacggtccgtacggtacgtaccgacggaaccgaccgtccgtccccgtaccccggtccggtctacccgttccgtacccgttaccccncccctttccgtaaccccgg

SEQ ID NO: 336810 - DNA, 519 bp, Homo sapiens
  misc_feature: GZ8MTXP02JN3B0.22.30.C08.1.454.CMB.2.raw
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
  modified_base (509)..(509): a, c, t, g, unknown or other
  misc_feature (509)..(509): n is a, c, g, or t
tcagacatacgcgtcacgaccggtgctcgatttagtctgacgtcaaagggaaaggggagagctctggggagtctgcaccatggattggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccaccacgaaggggtcggatccctgatcgcttctcgggctccagctcgtcggggccagcgctacctcaccntctcagcctcagtctgaanatgagctgactattactgtcagacagtgggacnctggcgtctgggctggttcggcggaggaccaaacgtgaccgctaggcagacccaggctcgcccctggcaacgtctcgtcccaccncctcacgtcg

SEQ ID NO: 336811 - DNA, 572 bp, Homo sapiens
  misc_feature: GZ8MTXP02FQORE.22.30.C08.1.454.CMB.2.raw
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctacttaangaagatggcctatttggcagccacacgaaggggtcggatcccgtgactcgcttcgtcgggctccgagctcgtcggggccagcgctacctcacnctccnccagccctcagtcngaagntggagctagacttatctgtacagacagtcgggacncgtggcgtctagggccttggtcgggacggacggtaccaaggcgtacggacccgtacgtaggtccaacgtccgaacggtcctaccgtccccgtcggtaacctactccgtccgttaccccgccctaccgtacgtacccgg

SEQ ID NO: 336812 - DNA, 555 bp, Homo sapiens
  misc_feature: GZ8MTXP02GF25P.22.30.C08.1.454.CMB.2.raw
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggcagccaccacgaaggggtcggatccctgatcgcttctcgggctccagctcgtggggccagcgctactcacntctccagcctccagtctgaaantgaggctgactattactgtacagacagtcggggacncgtgggtctcgtgggcttggttccgggacggtacgggaacccaagccgtacgacccgtcgtaggttaccgcccgaaggcctccgcccccgtggtccaacgtctacgttccccacctcctcgacgtcg

SEQ ID NO: 336813 - DNA, 615 bp, Homo sapiens
  misc_feature: GZ8MTXP02GNU5W.22.30.C08.1.454.CMB.2.raw
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (371)..(372): a, c, t, g, unknown or other
  misc_feature (371)..(372): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtggcatcaaacaacagccggagaaagggccctcgctacttaatgaagattggccatttggcagcacacaaggggtcggatcccngatcgcttctcgggctccagctcgtggggccagcgctaccncacnncncancctcagtcagaanatgacgctagaacttatactacgtacaagacagtagggaccgtcgtcggcgtcgtgggtcgttacgggttcgggacgggaacgggtaaccgaaggtccgtacgacccggttacgtacgggtaccaaccggacccgaaacgggtcctacccggtccccccgttacggtaacccgtaccgttcccgttacccgttacccccgtaccccgtcccgttaccgtaaccgg

SEQ ID NO: 336814 - DNA, 532 bp, Homo sapiens
  misc_feature: GZ8MTXP02GMFAQ.22.30.C08.1.454.CMB.2.raw
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaaagattggccatttggcagccaccacgaaggggtcggatccctgatcgcttctcgggctccgagctcgtcggggccagcgctacctcaccntcctccagccctccagtctgaagntgagctgactatactgtcagacagtgggacnctgggcgtcgtgggctggttcgggcggagggaccaaggctggacccgtctaggtcacggcccaaggcctcgccccctggcactcgtcgtcccgcctctcacg

SEQ ID NO: 336815 - DNA, 640 bp, Homo sapiens
  misc_feature: GZ8MTXP02FSBBE.22.30.C08.1.454.CMB.2.raw
  modified_base (387)..(387): a, c, t, g, unknown or other
  misc_feature (387)..(387): n is a, c, g, or t
tcagacatacgcgtcacgaccggtgctcgatttagtctgacgtcaaagggaaaggggagagctctggggagtctgcatcatggcttggaccccactcctcttcctcaccctcctcctccactgcacagggtctctctcccaggttgtactgactcaatcgccctctgcctctgcctccctgggagcctcggtcaacctcacctgcgttctagtagtcaacacgattactacaccgtcgcgtggcatcaacaacagccggagaagggccctcgctactaatgaagatggccatttggcagccaccacgaaggggtcggatccccgtgactccgtcttccggtcggtcctcgacgtccgtccggtccggggccgacgccgtcctacccnccacctactccctaccgaccgtcccctaccgtacgtcctaaggaagtagtacggacggtctacgtaacttaactttacgtcgtacgacgtaacgtagggtacgggacgtcggtcggtccgttcggtcggtcgttcgggttacgggcgggaacggacgaacgtcgtaccggtaccgtacggtacggtcgaccgaccggacgccgtcccgtcccgtcggtacctaccgtcgttcccgtacccctccctcctaccg

SEQ ID NO: 336816 - DNA, 548 bp, Homo sapiens
  misc_feature: GZ8MTXP02FG18U.22.30.C08.1.454.CMB.2.raw
  modified_base (375)..(376): a, c, t, g, unknown or other
  misc_feature (375)..(376): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcggatccctgatcgctctcgggctccgagctcgtcggggccgagcgctacctcacnnctccagcctccagtctgaagntgaggctgactatactgtacagacagtggggacncgtgggcgtcgtgggctggttcgggngggaggggaccaaggctggacccgtccgtaggtccaacggcccaagggcctcgcccccgtggtccactcgtcgttccccgcctcctcaccg

SEQ ID NO: 336817 - DNA, 587 bp, Homo sapiens
  misc_feature: GZ8MTXP02FUB7M.22.30.C08.1.454.CMB.2.raw
  modified_base (185)..(185): a, c, t, g, unknown or other
  misc_feature (185)..(185): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaagggccctcgctacttaatgaagattggccattttggcagccaccacgaagggggtcggatccctgatcgcttctcgggctccagctcgtcggggccgagcgctacctcaccntctccagccctccagtctgaagntggagctgactatctgtcagacagtgggacgngtgggcgttcgtcgggcgtggttccgggcggggtacgggaccaaggcgtcgaccggtccgtacgggtccacggtaccccgaaagggccttaccggccccccgttgggtccctaccgttccgttcccgttccccctacccctccctaccgtacccgg

SEQ ID NO: 336818 - DNA, 549 bp, Homo sapiens
  misc_feature: GZ8MTXP02I2S18.22.30.C08.1.454.CMB.2.raw
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaanacngccggagaaggccctcgctactaatgaagattggccatttggcagccaccacgaaggggtcggatccctgatcgcttcgcgggctccagctctcggggccagcgctaccgtcaccntcctccagcctccagtcctgaaacgntgagctgactattacngtcagacagtgggacncgtggcgtcgtgggcttggttccggcgggagggtaccaagcctaggacccgtcgtaggtccacgccgaaacggctacgcccccgtcggtccactcgtacgtcccccacctcctacgtaccg

SEQ ID NO: 336819 - DNA, 561 bp, Homo sapiens
  misc_feature: GZ8MTXP02H686D.22.30.C08.1.454.CMB.2.raw
  modified_base (185)..(185): a, c, t, g, unknown or other
  misc_feature (185)..(185): n is a, c, g, or t
  modified_base (255)..(255): a, c, t, g, unknown or other
  misc_feature (255)..(255): n is a, c, g, or t
  modified_base (368)..(368): a, c, t, g, unknown or other
  misc_feature (368)..(368): n is a, c, g, or t
  modified_base (416)..(416): a, c, t, g, unknown or other
  misc_feature (416)..(416): n is a, c, g, or t
  modified_base (542)..(542): a, c, t, g, unknown or other
  misc_feature (542)..(542): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtgacatcaacaacngccggagaagggccctcgctactatgaagatggccatttggcagccacacaaggggtcggatccctgatcgcttctcgggctcagctcgtcggggccgagcgctacctcaccntctccacgcctccagtctgagatgaggctagctattactgtacagacngtgggacgctcggcgtcgtggactggttacggcgggtacggaccaagtcgtcggacccgtcgtaacggtcacggacccgaaggcctccggccccctcgggtccgaccttccgttccgttacccccnccctcccgtacgtacccgg

SEQ ID NO: 336820 - DNA, 561 bp, Homo sapiens
  misc_feature: GZ8MTXP02FSVNQ.22.30.C08.1.454.CMB.2.raw
  modified_base (326)..(326): a, c, t, g, unknown or other
  misc_feature (326)..(326): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacaacagccggagaagggccctcgctacttaatgaaagattggccatttggcagccaccacgaaggggtcggatcccngatcgcttcgcgggctccgagctcgtcggggccgagcgctacctcaccntcctccagccctcagtctagaagntgagctgactatactgtacagacagtgggacngtcggcgtcgtggcttggtcggacgggacgggaaccaggcctggacccgtcgtacggtcacggacccgaaggccgtccgcccccgtggtaaccctacgtccgttccgtccccacccttccctacgacccg

SEQ ID NO: 336821 - DNA, 552 bp, Homo sapiens
  misc_feature: GZ8MTXP02IYVKK.22.30.C08.1.454.CMB.2.raw
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (537)..(537): a, c, t, g, unknown or other
  misc_feature (537)..(537): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacacagccggagaaggccctcgctacttaatgaagattggcctatttggcagccaccacgaaggggtcggatcccgtgatcgcttcgtcgggctccagctcgtcggggccgagcgcctacctcaccntcctccagccctccagtctgaagntgagctgactattactgtacagacagtgggactcgtggcgtcgtgggctggttcgggacggtagggaccaggcgtcgacccgtcgtaggtcacgtcccgaaggcctccgccccctggccaccgttctccggtccccncccttcctctaccgg

SEQ ID NO: 336822 - DNA, 564 bp, Homo sapiens
  misc_feature: GZ8MTXP02JAX21.22.30.C08.1.454.CMB.2.raw
  modified_base (186)..(186): a, c, t, g, unknown or other
  misc_feature (186)..(186): n is a, c, g, or t
  modified_base (369)..(369): a, c, t, g, unknown or other
  misc_feature (369)..(369): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacncctcggtcaacctcacctgcgttcttagtagtcaaacacgattacacaccgtcgcgtggcatcaaacacagccggagacggcctcgctactatgaagatggccatttggcagccacacgaaggggtcggatccctgatcgcttctcgggctccgagcgtcgtcggggccgagcgctactcacntctcacgcctacagtactgaagatgaagctagacgtattactgtacagacagtaggacgctggcgtcgtggctggttcggcggaggaccgaggctcgaccgtcgtacggcgacgacccgaaggtcctccgcccccgttcgggaacctaccgttccgtcccggttacccccaccccgtttaccacccgttacccgg

SEQ ID NO: 336823 - DNA, 577 bp, Homo sapiens
  misc_feature: GZ8MTXP02I852E.22.30.C08.1.454.CMB.2.raw
  modified_base (384)..(384): a, c, t, g, unknown or other
  misc_feature (384)..(384): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgatttacacaccgtcgcgtggcatcaacacagccggagaaggccctcgctactaatgaagattggcctattttggcagccaaccacgaagggggtcgggactcccgtgatcgcttcgtcgggcctccagctcgtcggggccgagccgcctacctccaccntcctcccacgccctccacgtcctgaaacgatggagctagacttatacctgtcagacagtgggacgcgtcggcgtcgtgggtcgtggttcgggcgggaggaccaagctgacccgtacgtaggtcacggaccgaacggtcctcgcccccgttggcctaccgtccgttccggttcccgcccttcccgtcgtaccgg

SEQ ID NO: 336824 - DNA, 578 bp, Homo sapiens
  misc_feature: GZ8MTXP02I1VFQ.22.30.C08.1.454.CMB.2.raw
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacacngccggagaaggccctcgctacttangaagattggccatttggcagccacacgaaggggtcggatcccctgatcgcttctcggctccagctcgtcggggccgagcgctacctcaccntctcacgccctccagtctgaacgntgagctgactatcctgtcagacngtaggacgntggctcgtggcctggttcgggcggacggggacccaaggtcgtacgacccggtaccgtaggtacaccggtacccgaacggcctaccggtcccccgtaccgggtcctacccgttccgttccggttcccccggccccttccgttaaccgtccccgg

SEQ ID NO: 336825 - DNA, 524 bp, Homo sapiens
  misc_feature: GZ8MTXP02FSXK9.22.30.C08.1.454.CMB.2.raw
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccacacaaggggtcggatccctgatcgcttcncgggctccagctcgtcggggccgagcgctacctcaccntctccagccctcagtctgaagntgagctgactatctgtcagacagtgggacncgtggcgtcgtgggctgttcgggcggagggaccaggctcgaccgtcaggtccacggcccaaggctcgcccctggcactctcgttcccacctcctctacg

SEQ ID NO: 336826 - DNA, 602 bp, Homo sapiens
  misc_feature: GZ8MTXP02IT32P.22.30.C08.1.454.CMB.2.raw
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttggcagccaccacgaagggggtcggatcccctgactcgcttctcgggctccagctcgtggggccagcgctacctcaccntctccagccctccagtctgaagatgagctgactattacngtacaganatgggacgctgggctcgtgggcttggttccggcgggtagggacccaaggccgttacggaacccgttccgtaacggggttccacggaccccgtaaagggcccttaccggcccccccgttgggtccccaaccgttcccgtttccggttaccccccacccccggtttcccttaccgtaacccgg

SEQ ID NO: 336827 - DNA, 709 bp, Homo sapiens
  misc_feature: GZ8MTXP02JKBOL.22.30.C08.1.454.CMB.2.raw
  modified_base (380)..(380): a, c, t, g, unknown or other
  misc_feature (380)..(380): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacaggccggagaagggccctcgctactaatgaagattggccatttggcagccaccacgaagggggtcggatcccgtgatcgtcttcgtcgggcctccagctcgtcggggccgagcgctacctcacctntcctccgacgccctccagtcctagaaagtacgtaggaacggtctcggaacttacgttaccgtgggtacaacgacctaaggttcgggggacgtcgttcggggcgttacgtcgggtcgttcgggttccggggaccggggagggggaaccctaaacgggtccgtacgggtaaccccggtttacccggtagggttacccgaacggtacccccgaaacggggtcccgtttacccccgggacccccccgtttacccggggtccgaacccttttaccccggttcccggtttcccccccgtaacccccctttacccggttccccgtaaaccccgggg

SEQ ID NO: 336828 - DNA, 609 bp, Homo sapiens
  misc_feature: GZ8MTXP02HD5RF.22.30.C08.1.454.CMB.2.raw
  modified_base (429)..(429): a, c, t, g, unknown or other
  misc_feature (429)..(429): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagatggcctagtttggcagccaccacgaaggggtcggactccgtgatcgcgttcgcgggtctccagctcgtcggggccgagccgctacccgtcaccgctcctccacgtccctccacgtctgaagcgtgacgcgtagacttacttcngtacgagtacagtgggaccgtcgtgggtccgtcgtggtcgttggttccgggacgggaacgggtaccaaggtcgtacggtacccgtacgacggtcaccggaccgaacggtccgaccgtccccccgtacggtccctaaccgttccgttacccgtcccccgtaccctcccgttaccgacccgg

SEQ ID NO: 336829 - DNA, 527 bp, Homo sapiens
  misc_feature: GZ8MTXP02FVI0E.22.30.C08.1.454.CMB.2.raw
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaacgggccctcgctacttaatgaagatggccatttggcagccacacgaaggggtcggatccctgactcgcttcgtcgggctccagctcgtcggggccgagcgctacctcaccntctccagccctcagtctgaagntgaggctgactatactgtacagacngtgggacnctggcgtcgtgggctggtcggcggagggaccaagctgaccgtctagggtcacgcccgaaggctcgccccctggcactctcgtcccgcctcctcacg

SEQ ID NO: 336830 - DNA, 585 bp, Homo sapiens
  misc_feature: GZ8MTXP02JAFTU.22.30.C08.1.454.CMB.2.raw
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctactaatgaagattggcctatttggcagccacacgaagggggtcggactcccgtgatcgcttcgtcggctccagctcgcggggccagcgtctacctcaccnctcctccacgccctccagtctagaaagngtgacggtctaggtactattccgagttaccagacgagtcgggactcgtggcgtcgtgggcttgggtcgggcggaacgggacaacggtcgacgacccgtcgtaggtccacggtccccgaaggccctccggcccccgtaggtcccacgtccgttccgttcccccgccctcccgtcgtacccgg

SEQ ID NO: 336831 - DNA, 533 bp, Homo sapiens
  misc_feature: GZ8MTXP02GPS4I.22.30.C08.1.454.CMB.2.raw
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
tcagacatacgcgtcacgaccggtgctcgatttagtctgacgtcaaagggaaaggggagagctctggggagtctgcaccatggcttggaccccactccctcttcctcaccctcctcctccactgcacagggtctctctcccaggttgtactgactcaatcgccctctgcctctgcctccctgggagcctcggtcaacctcacctgcgttcttagtagtcaacacgattactacgccgtcgcgtgcatcaacacagccggagaaggccctcgcgtactaactgaagattggccatttggcagccaccacgaaggggtcggatccctgatcgcttcgtcgggctccagctctggggccagcgctacgtcaccntctcagccnccagtctgaagntgngctgactatactgtacagtacagtgggacngtggcgttcgtggcctgttcggacggacggtacaagcgtacgaccgtcgtaggtcacgcccgaaggcctacgcccccgtggcacgtctcgtcccgcctcctacgaccg

SEQ ID NO: 336832 - DNA, 599 bp, Homo sapiens
  misc_feature: GZ8MTXP02JDRRZ.22.30.C08.1.454.CMB.2.raw
  modified_base (379)..(379): a, c, t, g, unknown or other
  misc_feature (379)..(379): n is a, c, g, or t
  modified_base (563)..(563): a, c, t, g, unknown or other
  misc_feature (563)..(563): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattacacaccgtcgcgtggcatcaacaacagccggagaagggccctcgctactaatgaagattggcctattttggcagccaccacgaaggggtcggatccctgatcgcttcgtcgggctccagctcgtcggggccgagccgcctaccgtcacccnctcctacccgacgcccctccgtacgtcctagaaacgtatggacggctaggaaccttattacctggtacctaagacgagtacggggacgtcgtcgggtcgtcgtgggtctgggttcggcgggaggacacgcgtagcccgtacgtacggtcaccggccagggccctaccggcccccgtggtaaccnccgttcctccggtcccctaccctccgtacgtcccgg

SEQ ID NO: 336833 - DNA, 622 bp, Homo sapiens
  misc_feature: GZ8MTXP02JE2J0.22.30.C08.1.454.CMB.2.raw
  modified_base (376)..(376): a, c, t, g, unknown or other
  misc_feature (376)..(376): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacgcctcggtcaacctcacctgcgttcttagtagtcaacacgattactacaccgtcgcgtggcatcaaacaacagccggagaaggccctcgctactaatgaagatggcctatttgcagccacacgaaggggtcggactcctgactcgcttcgtcgggctccgagctcgtcggggccgagcgctacctcaccntcctcacgccctccagtctagaagatggacggctggtaactattacgtgtacagacagtacggggactcggtggcgttcgtcgggtcgttagggttccgggacggggacgggaaccgtaaggcgtacgacccgttacgtacggtaccgacggacccgaaacggcccgtcccggtcccccgttcgggtaacctaacccgttccgtacccggttcccccaacccccggtttccctaccgtaaccccgg

SEQ ID NO: 336834 - DNA, 549 bp, Homo sapiens
  misc_feature: GZ8MTXP02JAXF4.22.30.C08.1.454.CMB.2.raw
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattacctacaccgtcgcgtggcatcaacaacagccggagaagggccctcgctacttaatgaagattggcctatttggcagccaccacgaaggggtcggaatcccgtgatcgcttcgtcgggctcagctgtcggggccgagcgcctacctcaccntcctccacgcctccagtctagaagctggacgctgactatactgtcagacatgggacngtggctcgtgggctggttacggcggtacggaccgaagcgtaggacccgtcgtaggtcgaacgtccgaacggtcctccgcccccgtggtcacgtctcgtcccgcctccgctacg

SEQ ID NO: 336835 - DNA, 605 bp, Homo sapiens
  misc_feature: GZ8MTXP02GSNZS.22.30.C08.1.454.CMB.2.raw
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggcctattttggcagccaccacgaagggggtcggatccctgactcgcttcgtcgggctcagctcgtcggggccgagcgctacctcaccntctccagcctccagtctgaagntcgagctgactattactgtcagacagtgggacgcgtgggcgtcgtgggcgtcggttcggggcgggtaacggggaccctaagccgtacggacccggttaccgtagggtccgacggaccccgaaacgggtccctccggccccccgttcgggtaacctaccgttccgttcccggttacccccgccccttcccgttaccgtacccggg

SEQ ID NO: 336836 - DNA, 543 bp, Homo sapiens
  misc_feature: GZ8MTXP02JCUSJ.22.30.C08.1.454.CMB.2.raw
  modified_base (185)..(185): a, c, t, g, unknown or other
  misc_feature (185)..(185): n is a, c, g, or t
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaaggccctcgctactatgaagattggccatttggcagccaccacgaaggggtcggatccctgatcgcttcncggctcagctcgtcggggccgagcgcctactcaccntcctccagccctccagtctgaaagntggacgctagactattacctgtcagacagtgggacgcgtcggcgtcgtgggtctcggttcgggacgggaggaccaagccgtgacccgttcgtaggtcacgcccgaagcctcgccccctggtccactcgtacgtcccacctcctactacg

SEQ ID NO: 336837 - DNA, 657 bp, Homo sapiens
  misc_feature: GZ8MTXP02GCQLS.22.30.C08.1.454.CMB.2.raw
  modified_base (337)..(337): a, c, t, g, unknown or other
  misc_feature (337)..(337): n is a, c, g, or t
  modified_base (387)..(387): a, c, t, g, unknown or other
  misc_feature (387)..(387): n is a, c, g, or t
tcagacatacgcgtcacgaccggtgctcgatttagtctgacgtcaaagggaaagggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgtattactacaccgtcgcgtggcatcaacaacagccggagaacgggccctcgctacttaatgaaagtattggcctagttttggcagccaccacgaagggggtcggactcccngactcgcttcgtcgggctcagctcgtcggggccgagcgcctacctcaccnctcctaccacgccctccgaacgtctagaagattggaggctagacttatactgtcagacagtacggggacgtcgtggtcgtcgtgggtcttgggttccgggcgggaacgggaaccaacggtccgtacgggtaccccggttacggtaacgggttaccgaacggtccccgaaaacggggtcccttaccccgggtaccccccgttacgggtcccctaaaccgttccgtttaccccggttaccccccgtaaccccttccccgtaccgtaacccgg

SEQ ID NO: 336838 - DNA, 604 bp, Homo sapiens
  misc_feature: GZ8MTXP02JF8PK.22.30.C08.1.454.CMB.2.raw
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattacacaccgtcgcgtggcatcaacacagccggagaagggccctcgctactaatgaaagattggcctatttggctagccaccacgaagggggtcggatcccgtgatcgcttcgcgggctccgagctcgtcggggccagcgcctaccgtcaccatctccacgccctccagtcctagaaagtactggaagctagacttatctggtcaagacagtgggacgcgttggcgtcgtgggctacgggttcgggcgggacgggtaccgaacggtctcggtaacccgtccgtaggtcgaccgcccgaaacggtcctaccggcccccttagggtccctaccgttcccgttccggtttcccccgcccgtttaacccgttccgaacccggg

SEQ ID NO: 336839 - DNA, 700 bp, Homo sapiens
  misc_feature: GZ8MTXP02GJAWL.22.30.C08.1.454.CMB.2.raw
  modified_base (464)..(464): a, c, t, g, unknown or other
  misc_feature (464)..(464): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctctgcctctcgcctcccgtgggacgcctcggtcaacctcacctgcgttcttagtagtcaacacgtattactacaccgtcgcgtggcatacaacaacacgaccggagaacgggccctcgactaacttaatagaaagtagttcggaccttagttttcggacacgaccaaccgaacgggaacggggggtcggaacgtccccgtagacgtcgtccgttccgtccggggtcctccgagtccgtcggtccggggccgacgcgacctacctaccacctctcctacacgccctccgagtctagaaagngtagacggtctacgtaacttacgttacttacgacgacgaacgtagttacggggacgtcggtcgggtcgttcggttcgggtcgttcggggttcgggacggggacgggaaccgtaacggcgtacggacccgttacggtacggtaccgaacgacccggtaacggtccttcccggacccccggttcggtcctacccgttcccgttcccgggttcccccgtccctcccgtaaccgtcccgg

SEQ ID NO: 336840 - DNA, 626 bp, Homo sapiens
  misc_feature: GZ8MTXP02J2CVN.22.30.C08.1.454.CMB.2.raw
  modified_base (377)..(377): a, c, t, g, unknown or other
  misc_feature (377)..(377): n is a, c, g, or t
  modified_base (419)..(419): a, c, t, g, unknown or other
  misc_feature (419)..(419): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaaggggtcggatccctgatcgcttcgtcgggctccagctcgtcggggccgagcgctacctcgaccntcctccacgcctccagtctgaacgagtgagctgactattacngtacagacagtggggacgcgtggcgtcgtcgggcgttggttccgggacgggacggggtaccaaagggccgttacgggacccgttccgtaacggggtccaaccgggtaccccgaaacgggtccctcccgggtcccccccgttgggtcccgtacccgttcccgttcccggtttacccccccgacccctttaccccgtccgtaccccggg

SEQ ID NO: 336841 - DNA, 562 bp, Homo sapiens
  misc_feature: GZ8MTXP02JKJO1.22.30.C08.1.454.CMB.2.raw
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (525)..(525): a, c, t, g, unknown or other
  misc_feature (525)..(525): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccatttgcagccacacgaaggggtcggatccctgatcgcttcgtcgggctccagctctcggggccgagccgtctacctcaccntctccacgcctcacgtctagaacgntgagctgactatctgtcagacagtcggacgtcgtggcgtcgtgaccgttggttcggacgggtacggaccgagcgtacgaccgtccgtaggtcacgcccgtaaaggccttaccgcccccgtggtaacnccgttccgtccgttccccgtccctcccgtacgcccgg

SEQ ID NO: 336842 - DNA, 578 bp, Homo sapiens
  misc_feature: GZ8MTXP02FYMF0.22.30.C08.1.454.CMB.2.raw
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctcgctacttaatgaagatggccattttggctagccaccacgaagggggtcggatcccgtgatcgcttcgcgggctcagctcgtcggggccgagcgctacctcacntctcacgccctcagtcngtaanagtgaggctgactatactgacagacngnggggacncgtggtcgtcgtgggtctcgggttcgggacgggaacgggaaccgacggtccgtacggtacccgtccgtaaggggtccacggacccgaacgggtcctccggcccctcggtcctaccgccgttccggtcccctcccttccgcgtaccgg

SEQ ID NO: 336843 - DNA, 575 bp, Homo sapiens
  misc_feature: GZ8MTXP02IYHW4.22.30.C08.1.454.CMB.2.raw
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctactaatgaagattggcctatttggcagccaccacgaaggggtcggatccctgatcgcttcncggctccagctcgtcggggccgagcgctacctcaccntcctccagccctcagtctgaagctgacgctagactattacctgtcagacagtggggaccncgtgggcgtctgggcttggttccgggcgggaacgggaccaaaggtctacggacccgttccgaggtccgaacgtcccgaaaggccctccgccccccgttggtcccacgttccttcccggtccccgcccttccgtcgacccgg

SEQ ID NO: 336844 - DNA, 587 bp, Homo sapiens
  misc_feature: GZ8MTXP02HM0UQ.22.30.C08.1.454.CMB.2.raw
  modified_base (382)..(382): a, c, t, g, unknown or other
  misc_feature (382)..(382): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgtcgttcttagtagtcaacacgattactacaccgtcgcgtggcatcaacaacagccggagaagggccctcgctacttaatgaagatggcctatttggcagccacacggaagggggtcggactcccctgactcgtcttcgtcggctccagctcgtacggggccgagcgctacctccacnctcctccacgccctccgacgtctacggaaagtagtaggagtcgtagtaacttacttaccgtgtacgagaccgagtcgggacgtcgtcggtcgtcgtggcgtcggtcggacgggacggacagtcgtacgaccgtcgtacggtacaccggagtccgccgtccccgtgtccgtaactccgtccgttcccctacctcctcgtaccgtcg

SEQ ID NO: 336845 - DNA, 552 bp, Homo sapiens
  misc_feature: GZ8MTXP02FFV4I.22.30.C08.1.454.CMB.2.raw
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaangaagatggccattttggcagccaccacgaaggggtcggatcccngatcgctcncgggctccagctcgtcggggccgagcgctacctcaccntctccagccctcagtctagaacgatggagctgacttatactgtacngacagtggggacgcgtgggcgtcgtgggtctggttcgggcgggagggaccaaggcgtggacccgtcgtacggtcacgcccgaaggccctcgccccctcggccactcgtccgttccccgccctcctcgtacccg

SEQ ID NO: 336846 - DNA, 652 bp, Homo sapiens
  misc_feature: GZ8MTXP02FWI1Z.22.30.C08.1.454.CMB.2.raw
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaaggccctgctacttaangaanatggcctatttggcagccaccagaagggggtcggatcccgtgactcgcttcgtcgggtctccgagcctcgtcggggccgagcgcctaccgtccaccgntcctccagtccctccagtctagaacgagtgagggctacgacttacttactggtccaaggtaccagttaggggaccgtcgtcggggcgttcgtcgggtcttcgggtttacggggcgggtagggggaacccaaagggtccgtacgggtaaccccggttccgtaacggggtccaaccgggaccccgaaacgggtccgtaccggcccccccgtttacgggccctaaccgttccgttcccggttcccccggcccccttcccgtaccgtaccccgg

SEQ ID NO: 336847 - DNA, 562 bp, Homo sapiens
  misc_feature: GZ8MTXP02F1RZO.22.30.C08.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (375)..(375): a, c, t, g, unknown or other
  misc_feature (375)..(375): n is a, c, g, or t
  modified_base (447)..(447): a, c, t, g, unknown or other
  misc_feature (447)..(447): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtgcgtggcatcaacaacagccggagaaggccctgctacttangaagntggccatttggcagccaccagaaggggtcggatcccgtgactcgcttcgtcgggctccgagctcgtcggggccgagcgtctaccgtccaccntcctcccagcccctaccaggtcctagaagtagtggaggctaggaacttagttactgtacagacagtgggacncgtgggctcgtaggctggtcggacgggtagggaccaggcgtcgaccgtcgtacggtcacgacccgaaggcctaccgccccgtagtctaccgtctccgtacccacctcgtacaccg

SEQ ID NO: 336848 - DNA, 706 bp, Homo sapiens
  misc_feature: GZ8MTXP02JFEPO.22.30.C08.1.454.CMB.2.raw
  modified_base (190)..(190): a, c, t, g, unknown or other
  misc_feature (190)..(190): n is a, c, g, or t
tcagacatacgcgtcacgaccggtgctcgatttagtctgacgtcaaagggaaagggggagagctctgggggagtctgcaccatggcttggaccccactcctcttcctcaccctcctcctccactgcacagggtctctctcccaggttgtactgactcaatccgccctctgcctctgcctcccgtgggacncctcggtcaacctcacctgcgttcttagtagtcaacacgtattactacaccgtcgcgtggcatcaacaacaggccggaagaacgggccctcgctactaatgaagattggcctagtttggcacgccaccgacggaagggggtcggactcccgtgactcgtcttcgtcgggactccagtctcggtccggggccgagccgtccgtacctcacctactcctccacgtccctcctaacgtctaggaacgtagttggacgtctaggtacttactacgtgtaccagaccgagttacgggacgtcgtcggtcgtcgtcgggtccgtggggttaccgggacggggtacgggtaccgaacggtccgtaccggggtaccccgttaccggttaacgggcccacccggggtaacccggaaaccgggtcccgtaaccccggtaccccccggtcggggttaacccctaacccgtttacccggttcccccggttaacccccttacccccgttacccgtcccgtaaccccggg

SEQ ID NO: 336849 - DNA, 575 bp, Homo sapiens
  misc_feature: GZ8MTXP02IZH5J.22.30.C08.1.454.CMB.2.raw
  modified_base (256)..(256): a, c, t, g, unknown or other
  misc_feature (256)..(256): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagacatacgcgtcacgaccggtgctcgatttagtctgacgtcaaagggaaagggggagagctctggggagtctgcaccatggcttggaccccactcctcttcctcaccctcctcctccactgcacagggtctctctcccaggttgtactgactcaatcgccctctgcctctgcctccctgggagcctcggtcaaccctcacctgcgttcttagtagtcaacacgattactacaccgtcgcgtggcatcaacaanagccggagaacggccctcgctactaatgaagattggcctatttggcagccacacgaaggggtcggatcccgtgactcgcttcgtcgggcctccgagctcgtcggggccgagcgctacctcacntcncacgccctccatctagagatgagctgactattaccngtcagacagtgggacncgtggcgttgtggcgttggtcggacggggacggaacaggtccgtgaacccggttcgtaacggtcgaccggcccgaaacggcctacccggtcccccgtcggtcgaccttcgtcccggttacccaccccgttcctccgaaccg

SEQ ID NO: 336850 - DNA, 552 bp, Homo sapiens
  misc_feature: GZ8MTXP02FZAIV.22.30.C08.1.454.CMB.2.raw
  modified_base (282)..(282): a, c, t, g, unknown or other
  misc_feature (282)..(282): n is a, c, g, or t
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgccctcccgtgggagcctcggtcaacctcacctgcgttcttagtagtcaacacgattactacaccgtcgcgtggcatcaacaacagccggagaacggccctcgctactangaagatgctattggcagccacagaggggtcggatccngatcgctcgcggctccagctcgcggggccagcgctacncacntccncacgcccncagtctagagatgagctagtacttattactgtacacgacngtacgggacgtcgtcgggcgtcgtggcgttcggtcgggacgggaggacaggcgtacgccgtcgtagggtcacggacccgaacggtcctcccgccccgtcggtcctacgtccgtccgttccccgcctccgtactaaccgg

SEQ ID NO: 336851 - DNA, 649 bp, Homo sapiens
  misc_feature: GZ8MTXP02GZ994.22.30.C08.1.454.CMB.2.raw
  modified_base (279)..(279): a, c, t, g, unknown or other
  misc_feature (279)..(279): n is a, c, g, or t
  modified_base (406)..(406): a, c, t, g, unknown or other
  misc_feature (406)..(406): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactaccaccgtcgcgtgcatcaacaacagccggagaaggcctcgctactangaagatgctatttggcagccaccagaagggggcggatccctgatcgcttcgcgggcctccgagctcgtcggggccgacgcgcctaccgtccaccgactcctaccacgcccttccgagtctacgaagntggagctgacttattacgtcgtacgagacgagttacggggaccgtcggtcgggtcgttcggtcggggtccgttgggttaccggggacgggtacggggaaccgaacggtcgtcgggaaacccggttcgtaccgggtaccgacggaccccgtaaaggtcccgtccgtacccccccgttgggtaacccgttaccctacccggtttacccggttcccccaaccccgtttccccgtaacgtccccggg

SEQ ID NO: 336852 - DNA, 590 bp, Homo sapiens
  misc_feature: GZ8MTXP02F8032.22.30.C08.1.454.CMB.2.raw
  modified_base (185)..(185): a, c, t, g, unknown or other
  misc_feature (185)..(185): n is a, c, g, or t
  modified_base (281)..(281): a, c, t, g, unknown or other
  misc_feature (281)..(281): n is a, c, g, or t
  modified_base (441)..(441): a, c, t, g, unknown or other
  misc_feature (441)..(441): n is a, c, g, or t
  modified_base (568)..(568): a, c, t, g, unknown or other
  misc_feature (568)..(568): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaaggccctcgctacttaangaagattggcctattttggctagccaccacgaagggggtcggatccctgatcgcttcgtcgggcctccgagctcgtcggggccgagcgtacctaccgtcaccatcctaccagcccctcagtctgaagatgaggctgactatactgtcagacagtgggacntacggcgtctgggctcggttcgggcgggtacgggaaccaagccgttagacccgttacgtacggtcgacgaccccgaaagggtcctaccggtccccccgtcggtccaccttccgtcccggttcccccnccccttacccgttactacccgg

SEQ ID NO: 336853 - DNA, 671 bp, Homo sapiens
  misc_feature: GZ8MTXP02IYLMS.22.30.C08.1.454.CMB.2.raw
  modified_base (338)..(338): a, c, t, g, unknown or other
  misc_feature (338)..(338): n is a, c, g, or t
  modified_base (379)..(379): a, c, t, g, unknown or other
  misc_feature (379)..(379): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacgcctcggtcaacctcacctgcgttcttagtagtcaaacacgattactaccaccgtcgcgtggcatcaacaacagccggagaacggccctcgctactaatgaaagatggcctatttggcagccacagaggggcggactccctgactcgcttcncgggcctccagctcgtcggggccgacgcgcctactccaccntcctccacgccctccagtctagaacgagtgaggtctagtactatttactgtacagactagtacgggacgtcgtcgggtcgtcgtcgggtcgttcgggttaccgggacgggggacggggaaacccgaacggtccgtacggtaccccggttaccggtacgggttaccggaccggaacccccggttaaacggccccgttcccgggtacccccccgtttacggggttccccaacccgtttccgtttaccccggttaccccccgtacccccttaccccgttcccgttaacccccggg

SEQ ID NO: 336854 - DNA, 698 bp, Homo sapiens
  misc_feature: GZ8MTXP02JJW78.22.30.C08.1.454.CMB.2.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctntgcctctgcctcctgggancctcggtcaacctcacctgcgttcttagtagtcaacacgattacacaccgtcgcgtggcatcaacacagccggagaaggccctcgctactangaantgccatttggcagccaccacgaaggggtcggatccctgatccgcttcgtcgggtctccgagctcgtcggggccgagcgctaccgtcacctntcctaccacgtccncctacgtctgaacgagttaggacgggcctaggtaaccttagtttaaaccgtcgttacgaacgacccgtaaagttggggaaacccgtgtacgggtccgttacccgttggggccccgtttaggttccggggacgggaacgggggttacccaaaaccgggttccggttacggaaccccgggttaccgttaaaacgggttccgaaaacgggtcccccgtaaaacggggccctaacccgggtcccccccgtaagggtccctaaaccgttcccgttaccccgggttcccctcccccgtcccgtttaccgtaaccccggg

SEQ ID NO: 336855 - DNA, 657 bp, Homo sapiens
  misc_feature: GZ8MTXP02GFAGZ.22.30.C08.1.454.CMB.2.raw
  modified_base (281)..(281): a, c, t, g, unknown or other
  misc_feature (281)..(281): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagacatacgcgtcacgaccggtgctcgatttagtctgacgtcaaagggaaaggggagagctctggggagtctgcaccatggcttgggaccccactcctcttcctcaccctcctcctccactgcacagggtctctctccaggttgtactgactcaatcgcctctgcctctgcctccctgggacgcctcggtcaacctcacctgcgttcttagtagtcaacacgattactacaccgtcgcgtggcatcaaacaacagccggagaacggccctgctactaangaagatggctattggcagccacacgaaggggtcggatcccgtgactcgctcgcgggctcgagctcgtcggggccgagcgctaccncacntcctccacgccctcacgtctaggaaagngtagacggtctagtaacttacttaccgtgtaccgaagtaccgaggttacggggacgtcggttcgggtcggttcgtagggtccgttcggggttaccggggacggggtaacgggaaaccgaacgggtccgtacgggtaaccccgttcggtaaccggtacgaaccggacccggaaacggtcccgtaccccgggtcccccgttcgggtaacccgtaccttcccggttccccgtacccccgtacccctccgttaccgtaaccgg

SEQ ID NO: 336856 - DNA, 656 bp, Homo sapiens
  misc_feature: GZ8MTXP02JZNP6.22.30.C08.1.454.CMB.2.raw
  modified_base (254)..(254): a, c, t, g, unknown or other
  misc_feature (254)..(254): n is a, c, g, or t
  modified_base (371)..(371): a, c, t, g, unknown or other
  misc_feature (371)..(371): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttctagtagtcaacacgattactacaccgtcgcgtgcatcaacaacngcggagaaggccctgctactaatgaagattggcctatttggcagccaccacgaaggggtcggatccgtgatcgcttcgtcgggctcgagtctcgtcggggccgagcgctacctcacnctcctccgacctccacgtctcgaagtatgtacggcgtacgtacttaattactacgtcgaacgaacgtacgtacgggttaacggcggtcggtcgggttccgtgggtacggttcggttcggggttaccggggaacgggggtaaccgaaacggccgtacggtacccggtaacccggttacggtacgacggccccgaaaacggccgtcccgtacccccggtcccggttaacctaaccgtcccgtttaccgttcccccgtaaccccgtcccctaaccgtaccggtcccgg

SEQ ID NO: 336857 - DNA, 524 bp, Homo sapiens
  misc_feature: GZ8MTXP02IB2TU.22.30.C08.1.454.CMB.2.raw
  modified_base (303)..(303): a, c, t, g, unknown or other
  misc_feature (303)..(303): n is a, c, g, or t
  modified_base (393)..(393): a, c, t, g, unknown or other
  misc_feature (393)..(393): n is a, c, g, or t
  modified_base (426)..(426): a, c, t, g, unknown or other
  misc_feature (426)..(426): n is a, c, g, or t
  modified_base (517)..(517): a, c, t, g, unknown or other
  misc_feature (517)..(517): n is a, c, g, or t
tcagacatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagcccggagaagggccctcgctacttaatgaagattggccattttggaanccaccacaaggggtcggatcccctgatcgcttctcggctccagctctggggcccgagcgctacctcaccatctcagcctccagtctgaantgaggctgactattactgtcagacatggggacncgtggcgtcgtggctgttcggcggagggaccaagctgaccgtctaggtcagcccaagctcgcccctggtcaactctacgttcccacgtccncacgtcg

SEQ ID NO: 336858 - DNA, 591 bp, Homo sapiens
  misc_feature: GZ8MTXP02JR3TI.22.30.C08.1.454.CMB.2.raw
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggaagcccacacgaagggggtcggatcccgtgatcgcttctcgggctcagctcgtggggccccgagcgctacctcaccatctccagccctcagtctgaantgagctgactatacngtcagacagtgggacgcgtgggcgttcgtgggtccgttggttccgggcgggaacggggacccaaggccgtacggacccgttccgtaacggtccgacggtccccgaaaggggccctccggcccccccgttggtaccaaccgttccgtcggtttcccccgcccttccgtccgacggttccg

SEQ ID NO: 336859 - DNA, 558 bp, Homo sapiens
  misc_feature: GZ8MTXP02HQ0RL.22.30.C08.1.454.CMB.2.raw
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgcctctgcctctgcctcctgggagcctcggtcaacctcacctgcgttcttagtagtcaacacgattactacaccgtgcgtgcatcaanaacngccggagaacggcctcgctactaangaagattgctagtttggcacgcacaacgaaggggtcggactcctgatcgcttcgtcggctccagctcgcggggccgagcgctactcacatctcacgtcctcctacgtactacgaagacgtagacgacgtacgtactacgttacgtacgtacgtaacgtacgtacgtacggacgtcgtcggtcgtcgtcggtcgtcggtcggacggacggacgacgcgtacgacgtcgtacgtcgacgacgacgcgtccgtccgtcgtcgctcgtcctcctaccctcctcgcg

SEQ ID NO: 336860 - DNA, 624 bp, Homo sapiens
  misc_feature: GZ8MTXP02GKU17.22.30.C08.1.454.CMB.2.raw
  modified_base (285)..(285): a, c, t, g, unknown or other
  misc_feature (285)..(285): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaaccctcacctgcgttcttagtagtcaacacgattactacaccgtcgcgtggcatcaacaacagccggagaaggccctgctactaatgaagnttggctatttggcagccaccacgaaggggtcggatcccgtgactcgcttcgtcggggctccagctcgtcggggccagcnccgtacctccacctntccgtccacgccctccgaagttcctagaaaagcttagggacggtcctaggtaactttacttaccgttggtaccgaagaaccgaggttacggggccgtcgtgggtcgtcggtgggtccgttgggttccggggacggtacggaactacggtcgacggtacccgtcgtagggtccaacggtcccgaggtcccgtaccgtcccccgtcgtccgacctccgtaccggtcccccacccttccgacgtaccg

SEQ ID NO: 336861 - DNA, 697 bp, Homo sapiens
  misc_feature: GZ8MTXP02JUAZH.22.30.C08.1.454.CMB.2.raw
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcctgggacgcctcggtcaacctcacctgcgttcttagtagtcaacacgattactacaccgtcgcgtgcatcaacacagcggagacggcctcgctactatgaagattggcctatttggcagccaccgaagaaggggtcggatcccgtgatcgcttcgtacgggctccgagtctacgtcggggcacgcgtcctacgtccacctcgtcctacccacgtccctaccgtacgtaccttaggaaacgtattcggaacggcttagaacccttagttaccgtggtacacggactacggtacgggtaccgcggtttcgggaccgtttcgtcggggtaccttcggggttaccgggacggggtaacgggaacctaaacgggtccgttaccgggaacccgtttaccggtaagggtacccaaccgggtaacccgaaacgggtcccaacccggttcccccgtaaccgggggttcctaaccccgttccgttaacccggttccccccaacccgtttcccgtaccggttaaaccccgg

SEQ ID NO: 336862 - DNA, 533 bp, Homo sapiens
  misc_feature: GZ8MTXP02IC0V9.22.30.C08.1.454.CMB.2.raw
  modified_base (185)..(185): a, c, t, g, unknown or other
  misc_feature (185)..(185): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (522)..(522): a, c, t, g, unknown or other
  misc_feature (522)..(522): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaacggcctcgctactaatgaagattgccatttggcacgcaccacgaaggggtcggatccctgatcgcttcgtcgggctaccgagctcgtcggggccagcgctactcacntcctcagcctccagtctgaaacgntgagctgactattactgtacagacatcggggacncgtggcgtctggcctggtacggcggagggaccagcgtgaaccgtcgtaggtcagcccaaaggtccacgccccctggccacgtctacgtccccncctcctcaccg

SEQ ID NO: 336863 - DNA, 599 bp, Homo sapiens
  misc_feature: GZ8MTXP02IAN99.22.30.C08.1.454.CMB.2.raw
  modified_base (341)..(341): a, c, t, g, unknown or other
  misc_feature (341)..(341): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacggccctcgctacttatgaagatgctatttgcagccacacgaaggggtcggatcccgtgatcgcttctcgggctccngctcgtcggggccgagcgctacctcaccntcctccacgtccctcgagtctagaacgntgagctagacttatactgtacagacagtgggacgcgtgggccgttcgtcgggtcgtcggttccggggcgggtaacggggaccaaggtcgacggtacccggttaccgtacgggtcgaccgacccgaaacgggtccctcccggtcccccgttcggtcctacccgttccgttccgtacccccacccccgttcctaccgtcccgg

SEQ ID NO: 336864 - DNA, 593 bp, Homo sapiens
  misc_feature: GZ8MTXP02F3M38.22.30.C08.1.454.CMB.2.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactacaccgtcgcgtgcatcaaacacngccggagaaggcctgctactangagatgctagttgcagccacgagaggggtcgatccgngactcgcttcgcgggtctcgagtctcgtcggggccgagcgcctaacctccacctcgtcctccgacgccctacccaaggtcctaggaaaagtgtacggacggctaggtaaccttatacctgtaccagacgagtcgggaaccgtgtcggcgtcgtggggacttcgggttcggaccgggagggaacccaggcctacgggcctacgtagggtccacggacccgacggccgtcccgccccgtcggtaacctcgtccgttccggtccccctcctcccgacgtacg

SEQ ID NO: 336865 - DNA, 603 bp, Homo sapiens
  misc_feature: GZ8MTXP02GDG38.22.30.C08.1.454.CMB.2.raw
  modified_base (396)..(396): a, c, t, g, unknown or other
  misc_feature (396)..(396): n is a, c, g, or t
  modified_base (465)..(465): a, c, t, g, unknown or other
  misc_feature (465)..(465): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacgcctcggtcaacctcaccgtgcgttcttagtagtcaaacacgtattacacaccgtcgcgtggcatcaaacaacaggccggagaacgggccctcgctacttaatgaagatggcctagttttggctagccaaccgacgaagggggtcggacgtcccgtgactcgtcttcgtcgggctccgagcctcgtcggggccgagcgcgtactccaccntcctccacgtccctccagtccagaagtactcggaagcgtacgtaactacttacgtcgtacaagactagngggtacgcgtggcgtcgtgggtcgttaggtcggcggacgggtaccagcgtcgaccggtacgtacggtcgacggcccgaacggccgtaccgccccgttacggtcctaccgtcgtccgtccccgacctccgttacgaccg

SEQ ID NO: 336866 - DNA, 553 bp, Homo sapiens
  misc_feature: GZ8MTXP02GLDPV.22.30.C08.1.454.CMB.2.raw
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtgcgtggcatcaaacaacagccggagaagggccctcgctacttaaatgaaagattggcctatttggcagcaccacaaggggtcggatccctgatcgcttctcgggctccagctcgnggggccagcgtctacctcaccagtctccagcctccacgtctgaagatgaggntgactattactgtcagacagtaggacgcgtgtcgtcgtgtgtcgtcggcgggacgggacgagcgtcgacgtaccgtacgtacgacgaccgacggccgtccgtccccgtccgtccgtaccgtctccgttcccgtaccctccctacctacg

SEQ ID NO: 336867 - DNA, 615 bp, Homo sapiens
  misc_feature: GZ8MTXP02IV8EO.22.30.C08.1.454.CMB.2.raw
  modified_base (378)..(378): a, c, t, g, unknown or other
  misc_feature (378)..(378): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattactacaccgtcgcgtggcatcaacacagccggagaaggccctcgctacttaatgaagatggcctatttggcacgccaccacgaagggggtcggactccccgtgatcgctttcgtcggctccagctcgtcggggccagcgctacctcaccntcctccacgccctccagtctagaaagatggagctgaactattacgtggtacagacagttggggaacgtcgtacgggtcgtacgtgggtcgtgggttcgggacggggagggaacccgaaggccgtacggaccccgtacgtaacggggtccgaacggacccgtaaacggcctaccggcccccgttcggtcccgaccgttaccgttcccggttccccgccccttcccgtacgtaacccgg

SEQ ID NO: 336868 - DNA, 573 bp, Homo sapiens
  misc_feature: GZ8MTXP02GC9GD.22.30.C08.1.454.CMB.2.raw
  modified_base (186)..(186): a, c, t, g, unknown or other
  misc_feature (186)..(186): n is a, c, g, or t
  modified_base (383)..(383): a, c, t, g, unknown or other
  misc_feature (383)..(383): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaacgggccctcgctacttaatgaaagattggcctaagttttggacagccaaccacgaaggggtcggatccctgatcgcttctcgggctccagctcgtcggggccgagcgctacctcaccntcctccagccctccagtctagaagatgagctgtaacttatactgtacaagacagtacgggacgcgtggcgtcgtgggtctcggttcgggacgggtacggaacgaaggcgtcgacccgtcgtacgggtcacggacccgaaggccgtccgtcccccgtggtcctactctaccgttcccaccctcctcgaccg

SEQ ID NO: 336869 - DNA, 603 bp, Homo sapiens
  misc_feature: GZ8MTXP02GC7ON.22.30.C08.1.454.CMB.2.raw
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (447)..(447): a, c, t, g, unknown or other
  misc_feature (447)..(447): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgccctccctgggagcctcggtcaacctcacctgcgttctagtagtcaacacgattactacaccgtcgcgtggcatcaacacagccggagaagggccctcgctacttaatgaagattggcctattttggctagccaccacgaaggggtcggatccctgatcgcttcgtcgggctccagctcgtcggggccgagcgcctacctcgaccntcctccagccctcgacgtctacgaagntggaggctaggactattactgtcagaccagtaggggtaccncgtcggtcgtccgtgggtccgttgggttccggggcgggacggggtaaccaacggtctacgggacccgttaccgtacggtccgaccgacccggtaacggcccgtccgccccccgttaggccctacgtccgtcgtaccccctccctccgactacccgg

SEQ ID NO: 336870 - DNA, 603 bp, Homo sapiens
  misc_feature: GZ8MTXP02JK8OK.22.30.C08.1.454.CMB.2.raw
  modified_base (186)..(186): a, c, t, g, unknown or other
  misc_feature (186)..(186): n is a, c, g, or t
  modified_base (328)..(328): a, c, t, g, unknown or other
  misc_feature (328)..(328): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (402)..(403): a, c, t, g, unknown or other
  misc_feature (402)..(403): n is a, c, g, or t
  modified_base (420)..(420): a, c, t, g, unknown or other
  misc_feature (420)..(420): n is a, c, g, or t
tcagacatacgcgtcacgaccggtgctcgatttagtctgacgtcaaagggaaaggggagagctctggggagtctgcaccatggcttggaccccactcctcttcctcacccttctcctccactgcaccagggtctctctcccaggttgtactgactcaatcgccctctgcctctgcctccctgggancctcggtcaacctcacctgcgttcttagtagtcaacacgattacacaccgtcgcgtggcatcaacaacagccggagaacggccctcgctactaatgaagattggcctatttggcagccaccacgaacggggtcggatcccgngatcgcttcgcgggctccagcctcgtcgggccgagcnctacctcaccnctctccacgccctcagtcctagaagnngaagctgacttattacngtacagaccagtacggggccacgttcgggacgttcgtcgggtccgttacggttccggggacgggtacggaccgaaacggtctacggaccgtacggtaggtccgaacggcccgtaaacgggcctccggcccccgttagggccaccgttccgtccgttccccgtaccccgtccgtacccaccggg

SEQ ID NO: 336871 - DNA, 531 bp, Homo sapiens
  misc_feature: GZ8MTXP02HM1BO.22.30.C08.1.454.CMB.2.raw
  modified_base (146)..(146): a, c, t, g, unknown or other
  misc_feature (146)..(146): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (384)..(386): a, c, t, g, unknown or other
  misc_feature (384)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (394)..(395): a, c, t, g, unknown or other
  misc_feature (394)..(395): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttntactgactcaatcgccctctgcctctgcctccctgggagcctcggtcaaacctcacctgcgttcttagtagtcaaacacgattactacaccgtncgtgcatcaanaacagccggagaaggcccncgctacttaaangaaagattggcctatttggcagccacacgaaggggtcggatccctgatcgcttcgtcgggctccagctcncggggccagcgctaccncacntcncncncncnnnanangagnnatatactntanaganagaggacgcgtgcgtcgtgcgtcggtcggacggacggacgaacgacgtcgtaccgtaccgtacgacgacgaccgacggcgtccgcccgtccgtcgactcgtccgtcccgtccctcctctcg

SEQ ID NO: 336872 - DNA, 590 bp, Homo sapiens
  misc_feature: GZ8MTXP02IPWLF.22.30.C08.1.454.CMB.2.raw
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgattacacaccgtcgcgtggcatcaacaacagccggagaagggccctcgctactaatgaagatggcctatttggcagccaccacgaaggggtcggatcccgtgatcgcttcgtcggctccgagctcgtcggggccgagcgccgtactccaccntcgtccagccctccagtctgaaagntgaggctgtaactattactgtacagacagtgggacgtcgtggcgtcgtggccgtggttcggcgggacgggacaagcgtacggacccgttaccgtaggtcgacgacccgaacggtcccgtcccgcccccgttcgggtaaccaccgttcccgttcccgttcccccaccccgtttccctacgtaaccccgg

SEQ ID NO: 336873 - DNA, 562 bp, Homo sapiens
  misc_feature: GZ8MTXP02GACVO.22.30.C08.1.454.CMB.2.raw
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggagcctcggtcaacctcacctgcgttcttagtagtcaacacgtattactacaccgtcgcgtggcatcaacaacagccggagaaggccctcgctactaangaagatggcctatttggcagccaccacgaaggggtcggatcccngatcgcttcgcgggctcagctcgtcggggccagcgctacctcaccntcctccagccctaccagtccagaacgatgagctgacttatctagtcagacagtagggacncgtcggtcgtcgtgggctacggtcgggcgggtacggggaacctaggcctggacccgtcgtacggtcacggtacccaaggtccaccgtcccctcggtcacccgttctccgtccccgccctccgtctaccgg

SEQ ID NO: 336874 - DNA, 741 bp, Homo sapiens
  misc_feature: GZ8MTXP02GPGQ0.22.30.C08.1.454.CMB.2.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (410)..(410): a, c, t, g, unknown or other
  misc_feature (410)..(410): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggacgcctcggtcaacctcacctgcgttcttagtagtcaacacgtattactacaccgtcgcgtggcatacaaacaacaggccggagaacgggccctcgctaacttaangaanattggcctagtttggcagccaccgaacggaacgggggtcggaactcccgtgacgtcgtacttccgtcggggcctaccgagccgtcggtcggggccgacgccgccgtaccctcgaccncgtcctaccacgtccctaccgtacgttcctagaaagagttacggacggtcgtacggaactttaacttacgttacgttaccgaaaggaaccgtaggtacggggaacgtccggttacgggtccgttcggtcgggtccgttcgggggttacgggacgggggacggggaaacccgtaaggccgttacgggtaaccccggttaccggtaacggttaccgaaccgggaaaccccggaacgggtccccgtccccggtaccccccggtttcggtaacccgttaaccctttcccggtacccgtttacccccaccccgttccccgtacccgttaacccggg

SEQ ID NO: 336875 - DNA, 670 bp, Homo sapiens
  misc_feature: GZ8MTXP02JP4QP.22.30.C08.1.454.CMB.2.raw
  modified_base (284)..(284): a, c, t, g, unknown or other
  misc_feature (284)..(284): n is a, c, g, or t
  modified_base (408)..(408): a, c, t, g, unknown or other
  misc_feature (408)..(408): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctcccgtgggacgcctcggtacaacctcacctgcgttcttagtagtacaacacgtattacacaccgtcgcgtgcatacaacaacacgcggagaacggccctcgctactangaagatgctatttcggcagccaccgacggaagggggtcggactcccgtagagtccgtcgttcgtcgggtctccgagtcctcggtccggggccgagccgaccttaccctccacctctcctacccncgtccctcgtacgtccgtagaaagtataggacgtcgtaagtacgttattacgtgtacgaagaccaggttagggacgcgttacggcgttcgtcgggtcgttgggttaccggggacgggacggtaaccgacggtccgtaccggtaccccggttacgtacgggaccacccgggtaacccgacggtccccgtacccggtcccccgttcgggtaacctcccgttcccggtacccgtttcccccgaccccgttccgtaccgtacccgg

SEQ ID NO: 336876 - DNA, 513 bp, Homo sapiens
  misc_feature: GZ8MTXP02HGZRF.22.30.C08.1.454.CMB.2.raw
  modified_base (186)..(186): a, c, t, g, unknown or other
  misc_feature (186)..(186): n is a, c, g, or t
  modified_base (324)..(324): a, c, t, g, unknown or other
  misc_feature (324)..(324): n is a, c, g, or t
  modified_base (388)..(388): a, c, t, g, unknown or other
  misc_feature (388)..(388): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctctgcctctgcctccctgggancctcggtcaacctcacctgcgttcttagtagtcaacacgattactacaccgtcgcgtggcatcaacaacagccggagaagggccctcgctactaatgaagattggccatttggcagccacacaaggggtcggatcccngatcgcttctcgggctccagctctggggccgagcgctactcaccatctccagcctccagtcctnaagatgagctgactatactgtcagacatggagcgtgcgtctggctgtcggcggaggccaagctagaccgtcaggtcacgcccaaggctcgacccccgtggccactcgtcgtcccgccctctcacg

SEQ ID NO: 336877 - DNA, 556 bp, Homo sapiens
  misc_feature: GZ8MTXP02JRAMM.22.30.C08.1.454.CMB.2.raw
  modified_base (373)..(373): a, c, t, g, unknown or other
  misc_feature (373)..(373): n is a, c, g, or t
  modified_base (506)..(506): a, c, t, g, unknown or other
  misc_feature (506)..(506): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaaacacgattactacaccgtcgcgtgcatcaacaacagccggagaagggccctcgctactaatgaagattggccatttggcagccaccacgaaggggtcggatccctgactcgcttcgtcgggctccagctctcggggccagcgctaccgcaccntcctccacgccctccagtcctgaaagactgagctagactatactgtcagacagtgggacgctgggcgtgtgggccgttggttcggacggtaggaccaagcgtacgaccgtctaggcacggaccaacgggtccnccgtcccccgtggtaacacccgtcgtccgtccccgcctcctcgtacccgg

SEQ ID NO: 336878 - DNA, 658 bp, Homo sapiens
  misc_feature: GZ8MTXP02FKKCV.22.30.C08.1.454.CMB.2.raw
  modified_base (283)..(283): a, c, t, g, unknown or other
  misc_feature (283)..(283): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaagggccctcgctacttaangaagattggcctagttttggcagcccaaccgacgaagggggtcggatcccgtgactcgctcgtcgggctccagctcgtcggggccgagcgcctaccaccaccgactcctcccgacgtccccctaccagtcctaggaaacgatcggaggctgaacttatacgtgtacagacagtacgggccgcgtcgggcgtctgggcttcgggttacgggccgggtaaggaaccccaaggtccgtcgggtaaaccccggttccgtaaacggggttccaaccgggaccccgtaaaacgggcccgttcccggccccccctttggggtaaccctacccgtttcccgtacccgtttccccccgaacccctttcccgaccgtaaccccgg

SEQ ID NO: 336879 - DNA, 598 bp, Homo sapiens
  misc_feature: GZ8MTXP02JSRIV.22.30.C08.1.454.CMB.2.raw
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (376)..(376): a, c, t, g, unknown or other
  misc_feature (376)..(376): n is a, c, g, or t
  modified_base (441)..(441): a, c, t, g, unknown or other
  misc_feature (441)..(441): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaanaacagccggagaacggcctgctactaangaagatggcctagtttggcagccaccacgaagggggtcggatcccgtgatcgcttcgcgggctccagcgtcgtcggggccagccgactacctcaccntcctccacgcctccgagtcctgaagatggaagctagtactattactgtacagacagtcggggacncgtggcgttgtcgggtcgttcggttcggggacgggacggaaccaaggtcgtacgacccgttacgtacgggtcaccggtaacccgacggtcctcccggcccccgtagggtccctaccgttccgttaccgttacccccacccgttccgtaccgtaccgg

SEQ ID NO: 336880 - DNA, 638 bp, Homo sapiens
  misc_feature: GZ8MTXP02IVNML.22.30.C08.1.454.CMB.2.raw
  modified_base (330)..(330): a, c, t, g, unknown or other
  misc_feature (330)..(330): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctccaggttgtactgactcaatcgccctctgcctctgcctccctgggacgcctcggtcaacctcacctgcgttcttagtagtcaacacgtattactacaccgtcgcgtggcatcaacaacaggccggagaacggccctcgctactatagaagattggcctagtttggcagccacacggaaggggtcggatcccngactcgtctcgtcggctccgagtcgtcgcggggccgagcncgtacctcaccntccncacgcctcgagtccagaagntagnggctaggtaacttatacgtgtacagacnggtagggacngtacggtcgttcgcgggtaccgttcgggttaccgggcggggtaacgggaaccgacggtacgtacggtacccggttacggtacggtaccgaaacgtcccggaaacggtccggtacccggtcccccgttacgggaacccttacccgttccgttccccggggttcccctcccccgttacccgtcgtaacccgg

SEQ ID NO: 336881 - DNA, 578 bp, Homo sapiens
  misc_feature: GZ8MTXP02F5VEK.22.30.C08.1.454.CMB.2.raw
  modified_base (337)..(337): a, c, t, g, unknown or other
  misc_feature (337)..(337): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaaacaacagccggagaaagggccctcgctaacttaatagaaagattggaccaattttggcaagccaaccaagaaggggtcggaatcccngatcgcttctcgggctaccagctcgtcggggccancgctacctcaccatctccacgcctccacgtctanaagatgagcgtnactaatacttagtcaanacagtaggacgcgtcgcgtgtcgcgtggtcggacggacggaacgaacgacgtcgtacgtacgtacggtacgacgaccgaacgacgtaccgtccccgtccgtaaccgtacctactaccgttacccgtaccctaccctacctacg

SEQ ID NO: 336882 - DNA, 655 bp, Homo sapiens
  misc_feature: GZ8MTXP02GTB5W.22.30.C08.1.454.CMB.2.raw
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtgcatcaacaacagccggagaaggccctcgctactatgaagatgcatttgcagccacacgaaggggtcggactccctgatcgccgttacgtccgggctaccgagcctcgtcggggcccgagccggcctaccctcaaccatccctaccgacgtaccctccgaacgtctaggaaacgtagtacggaggtacctaggtaaccttaatttaccgtagtacgtaacgacgtaacggttacggggaacgcggttcggtacggttcgtaggggcttcgggttcgggacggggtacgggtaacccgaggtccgtacggacccgttacggcggtacaccggtacccgaaacggtccgtcccggcccccgtggaacccgtaccgtaccgttccgtacccccaccgtacccctacgtaacccgg

SEQ ID NO: 336883 - DNA, 660 bp, Homo sapiens
  misc_feature: GZ8MTXP02HFP4Z.22.30.C08.1.454.CMB.2.raw
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
tcagacatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttctagtagtcaacacgtattacctacaccgtcgcgtggcatacaacaacncggccgagacggcctcgctactangaagnttggacctagtttggcacgtccacaacggtaggggtcggaactcccgtgactccgtcttcgtcggcctccgagtccgtcggccggggtaccacgccgtcctacctccgaacctcgtccctaccaccgtccctaccgtacgtcctagggaaactgtacggtagccgttaggtaactttacgttacgttacgtaccgtaagaccgtaagtcggggtaccgtcgtcggggtcgtccgtggtcgtcggttccgggacgggtaacggacgaacggtccgtaggacccgttacggtacgtaccgaccgaaccggacggtcctcccgtccccgtacggtccaccgttccggtcccgtcccctcccgtaccttcggaacccg

SEQ ID NO: 336884 - DNA, 760 bp, Homo sapiens
  misc_feature: GZ8MTXP02FNBIU.22.30.C08.1.454.CMB.2.raw
  modified_base (166)..(166): a, c, t, g, unknown or other
  misc_feature (166)..(166): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
tcagacatacgcgtcacgaccggtgctcgatttagtctgacgtcaaagggaaaggggagagctctgggggagtctgcaccatggcttggaccccactcctcttcctcaccctcctcctccactgcacagggtctctctcccaggttgtactgactcaatcgccctntgcctctgcctccctgggagcctcggtcaaccctcacctgcgttcttagtagtcaacacgattactacaccgtgcgtggcatcaacacaggccggagaaggccctgctactangagatgcatttgcanccacacgaaggggtcgggatcccgtgatcgctacgtcgggactccagcgtacgtggggccgagcgctaccgcaccgatcctccagccctccagtactagaaagacgttaggacgggtacttacggaaaccgttattaaaccgtggttacaaaccgggtaaacgaggttaccgggggaaccggtccgtaggggtccgggtttacgttcggggggtccttaacggggtttccgggggtaaccgggggaacggggtaaacccgaaaacgggtccggtttaccgggaacccccggtttaccccggttaaacgggggttcccgtaaacccggggtaccccctaaaaacgggggccccgtttacccccgggacccccccggtttaccgggggttaacccctcccggtttaaacccggttaccccggtttccccccaaacccccgtttccccgtaccccgtttaaccccgggg

SEQ ID NO: 336885 - DNA, 551 bp, Homo sapiens
  misc_feature: GZ8MTXP01BWUVY.2.81.H04.1.454.CMB.2.raw
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttacgtgtaggtatttagaagtgtcagtgtgagtgcagctggtggagtccggggagctggtcagcctgggggccctgagctctcctgttcagctctggatctacctttagtagtttggtagtgtagttgggttcgccgagcgtccgaggaagggccgtggagtgggtggcgaaacatgagtagagtagaagtagaagaaaataatagtaggacgtaccgtaggaagggacggacttacaccaactctaccagagacgaacgaacgaagaattagtagtatagtanactaatagagnaacgcgagagacgacgacgacgcgcgtgtagttaagttagtgttagtaagaagtaag

SEQ ID NO: 336886 - DNA, 542 bp, Homo sapiens
  misc_feature: GZ8MTXP01A449O.2.81.H04.1.454.CMB.2.raw
  modified_base (533)..(533): a, c, t, g, unknown or other
  misc_feature (533)..(533): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgaggtgcagctgggtggagtccgggggaggctgggtccagccgtggggggtccctgagactctcctgttcagcctctggattcacctttagtaggttttggatgagttgggtccgcgaggctccgagggaaggggcctgggagtgggtggccaaacatgagtacgatggaagtgagaaaactatagtggacgtcgtgaagggccgattcaccatctccagagacaagacaagaatttagtgtatctagctaaatgagcaagccgttgagagccgaagggacgacggctgtgtaattagtgttgngttaagaag

SEQ ID NO: 336887 - DNA, 578 bp, Homo sapiens
  misc_feature: GZ8MTXP01DQT9F.2.81.H04.1.454.CMB.2.raw
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttacgtgtaggtntttagaagtgtcagtgtgagtgcagngtggtggaggcgggaggcgtcggtcgcgcggtcgggtccgtgagactctctgtcncgctgtgtatctacgtttagttaggtttgtagtgtggtcggtccgcgngcgcgaggaggcgnggnggtggtcgacgaanagngagagagagagagaagaaatagtagtagacgtacgtaggacggacgtactacacactactacacgacgaacgaacgaacgtaaagtaaagtttaagttagttagtacgtacgtaacgtaagtagacgacgaacgtacgttaggacggacggacggaacggacggcggttcgtgttagttaagttagtggttagtaagaagtaag

SEQ ID NO: 336888 - DNA, 560 bp, Homo sapiens
  misc_feature: GZ8MTXP01A2XU0.2.81.H04.1.454.CMB.2.raw
  modified_base (362)..(362): a, c, t, g, unknown or other
  misc_feature (362)..(362): n is a, c, g, or t
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagcgtgggtttacttgttggtatttagaaggtgtccagtgtgaggtgcagctggtggagtccgggggagctgggtccagcctgggggtccctgagactctcctgttcagcctctggattcacctttagtaggttttggatgagtgggtccgcagctcgaggaggccgtggagnggtggcaaacatgagtacgagtaggagtagagaaaactatggtaggacgtccggttagaagggaccggatttaccaaccatcctacccagaacgacgaaaccganaaagtaatttagtagtactcgtanactaagagagcaacgcgacgagcgacggacgttacgaccgttgtgtgtaattgtagttgaagaagtaag

SEQ ID NO: 336889 - DNA, 609 bp, Homo sapiens
  misc_feature: GZ8MTXP01BCFIO.2.81.H04.1.454.CMB.2.raw
  modified_base (223)..(223): a, c, t, g, unknown or other
  misc_feature (223)..(223): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtntcagtgtgagtgcagctggtggagtccgggggagctgggtccagccgtgggggtcctgagactctcctgttcagcctctggattctacctttagtaggttttggatgtaggttgggtccgcgaggctccgaggggaaggggcctgggaggtggggtggaccaaacataagagtacgatagggaagtgaaagaaaaactgtagtaggaactccggtaggaacggggccgtattacacccgaatccgtaccaagaacgaacgaaacggaacaaagtaagtttagtgttatcctagactaaaagtgaagcaagccgttaggacgcggaccgaagggttaccacggggttctaaggtagttaagtttagtcggttagtaacggaagtaag

SEQ ID NO: 336890 - DNA, 571 bp, Homo sapiens
  misc_feature: GZ8MTXP01EP4WJ.2.81.H04.1.454.CMB.2.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagcggtggtttagtgtaggtctttagaagtgcagtgtgagtgcagngtggtggnggtcggggaggcgtggtcgcgcggtcgggtccgtgagactctctgtcncgcctcgtgtatctacgtttagttaggtttgtagtgtggtggtcgcgngcgcgaggaggcgnggnggtggtgacgaaacatgagtagagtagagtagaaagaaatagtagtaggacgtacgtaggacggacgtactacacactcacagaagaacgaacgaacgaaagtaagttagtagtagtacgtagacgtaagtagagcgaacgtacgagacggacggaccggaacggacggacggttcgttgttagttaagttagttaggttacgtaacgaagtaag

SEQ ID NO: 336891 - DNA, 580 bp, Homo sapiens
  misc_feature: GZ8MTXP01BURLX.2.81.H04.1.454.CMB.2.raw
  modified_base (235)..(235): a, c, t, g, unknown or other
  misc_feature (235)..(235): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcacatggaattggggctgagctgggtttacttgttggtatttagaaggtgtccagtgtgaggtncagctggtggagtccgggggagctgggtcagcctggggggtccctgagactctcctgttcagcctctggattcacctttagtaggttttggatgagttgggtccgcaggctccgagggagggcctggagtggggtgccaaaacataagagtacgataggaagtgaagaaaactatagtggactccgtagaagggccgattcaccatctccagagacgaaacgacaagaatttagtgtatctgactaaatgagcgaagccgttaggagaacggcccggaagggacccgaacgggttccttaagggtagttaagtttaagttggttaggaaccgttaagggtaaagg

SEQ ID NO: 336892 - DNA, 567 bp, Homo sapiens
  misc_feature: GZ8MTXP01EY1I7.2.81.H04.1.454.CMB.2.raw
  modified_base (490)..(490): a, c, t, g, unknown or other
  misc_feature (490)..(490): n is a, c, g, or t
  modified_base (541)..(541): a, c, t, g, unknown or other
  misc_feature (541)..(541): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtcagtgtgaggtgcagctggtagaggtccgggggaggcgtggggtccaggccgtggggggtccctggagactctcctgttcagcctctggattcactttagtaggttttgatgagttgggtccgcgaggctcgagggagggctgggagtgggtgccaaacatgagtacgatgggaagtagaaagtaaaaactgtagtaggactccggtagaaacggaccgtattcaccagtcctaccaagagaaccaacgaacaaagtaatttagngtatctagactaaatgagcaaggccttggagagccgaaggacgacgggttntgtgttaattgtggcgaagaagtaag

SEQ ID NO: 336893 - DNA, 606 bp, Homo sapiens
  misc_feature: GZ8MTXP01EEHRI.2.81.H04.1.454.CMB.2.raw
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
  modified_base (526)..(526): a, c, t, g, unknown or other
  misc_feature (526)..(526): n is a, c, g, or t
  modified_base (576)..(576): a, c, t, g, unknown or other
  misc_feature (576)..(576): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagctgggtttacttgttggtatttagagtgtcagtgtgaggtgcagctgggtggaggtccgggggagcgtgggtccaggccgtggggggtccctggacgactctcctgttcagcctntggtattctaccgttttagttaggttttggattggtaggttcgggtcccgccgaggcctaccgaggggaggggccgtggggaggtggggtcgaccaaanagtaagagtacgagtagggaagtagaaagtaaaacgtntagtacggacgtccggtaggaacgggtcctattaccaccatcctaccgaagacgaacgaaacgaactaaagtaatttagtntatctagactaaagtgacgcaacgcttaggacgacgccggaagacgcggntggtattaattagtgttagaacgaagtaag

SEQ ID NO: 336894 - DNA, 597 bp, Homo sapiens
  misc_feature: GZ8MTXP01EKOZC.2.81.H04.1.454.CMB.2.raw
  modified_base (510)..(510): a, c, t, g, unknown or other
  misc_feature (510)..(510): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaggtgtcagtgtgaggtgcagctggtggaggtccgggggagctgggtccaggccgtggggggtccctgagctctcctgttcagcctctggattcaccttttagtaggttttggattggagtttcgggtccgccaggctccgaggggaggggcctgggagtggggtgcccaaaacgataaggagtacgagtgggaaagtagaagaaaaactgtggtaggactccggtaggaacggggcccgtaattccgaccatcctaccgaagaacgaaccgaaacgaactaaagtaatttagngtatctagactaaagtgagcaagccttaggacgacgaccggaggaccgacgggctggtagttaattagtggttagaacggaagtaag

SEQ ID NO: 336895 - DNA, 586 bp, Homo sapiens
  misc_feature: GZ8MTXP01CBQ2Z.2.81.H04.1.454.CMB.2.raw
  modified_base (422)..(422): a, c, t, g, unknown or other
  misc_feature (422)..(422): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctgggtggaggtccgggggaggcgtgggtccagccgtggggggtccctggagactctcctgtcagcctctggattctacctttagtaggttttggatggtagtttgggtccgcgaggctccgaggggaaggggcctgggaggtgggtggccaaacgataagagtacgagtggaagtagaaanaaaactgtagtggactccggtaggaagggccgaattcaccatcctaccgaagacgaacaaacgaactaaaggtaatttaaggcgttatctaggactaaagtgagcaagccttaggagacggccgaggacngggctggtnttaattagttcgttagcgaagtaag

SEQ ID NO: 336896 - DNA, 642 bp, Homo sapiens
  misc_feature: GZ8MTXP01EO690.2.81.H04.1.454.CMB.2.raw
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggttttacttgttaggtattttagaaggtgtcagtgtgagtgcagctggtggagtccgggggagctgggtccagccgtgggggtccctgagactctcctgttcagcctctggattctaccttttaggtaggttttggatgtagtttcgggtccncgaggctcgaggggagggcctgggagtggggtgacccaaaanataagagtacgatagggaagtgaaagaaaaatgtagtaggactcggtaggaaacgggccctattaccaacctaattcccgtaccaaagacggtaaacaaaaccggaactaaaagggtaaattttaagggtgttaaatccttaaggaaacgtaaagtaagaacgacgaacgtacgttacgaacggacggacggaacggacggacggttacgtaagttagttaagtttagttaggttagtaacgttaagtaag

SEQ ID NO: 336897 - DNA, 554 bp, Homo sapiens
  misc_feature: GZ8MTXP01EVNT3.2.81.H04.1.454.CMB.2.raw
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgagtgcagctggtggagtccgggggagctgggtccagcgtgggggtccctgagactctcctgttcagtcctctggattctacctttaggtaggttttggatgaggttcgggtccgccgaggctccgaggggagggcctgggagtgggtgccaaanagtgagtacgatgggaagtgaaagaaaactgtgtggactcgtgaaggcgattcaccatcncagacgaacacgaanaagtattagngtatctagactaaatgaancaagccttaggagaggccggtaaggaccgacggcttgtagttaattagttggacggtgaagtaag

SEQ ID NO: 336898 - DNA, 514 bp, Homo sapiens
  misc_feature: GZ8MTXP01BMO38.2.81.H04.1.454.CMB.2.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (232)..(233): a, c, t, g, unknown or other
  misc_feature (232)..(233): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(249): a, c, t, g, unknown or other
  misc_feature (248)..(249): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (259)..(261): a, c, t, g, unknown or other
  misc_feature (259)..(261): n is a, c, g, or t
  modified_base (264)..(264): a, c, t, g, unknown or other
  misc_feature (264)..(264): n is a, c, g, or t
  modified_base (266)..(271): a, c, t, g, unknown or other
  misc_feature (266)..(271): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagcggtgttgtgtaggnttagaagtgcngtgtgngtncngnngngngnggngngngnngcgnggcngnnnctntnnnnnntntntgtgtgntgtgtgcgcgngcgcgaggaggcgtggnggtggngacgaacagngagagagtagagtagaagaaatagtgtagacgtcgaggacggacgtactacacactcacgacgacgaacgaacgaaacgtaagtaagttagtagttagtacgtacgtacgtaagtagacgcgaacgcgagacgacggacggacggacggcggttcgtgttgttaagttgttgttagtaacgaagtaag

SEQ ID NO: 336899 - DNA, 531 bp, Homo sapiens
  misc_feature: GZ8MTXP01AJ115.2.81.H04.1.454.CMB.2.raw
  modified_base (410)..(410): a, c, t, g, unknown or other
  misc_feature (410)..(410): n is a, c, g, or t
  modified_base (464)..(464): a, c, t, g, unknown or other
  misc_feature (464)..(464): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtattttagaaggtgtccagtgtgaggtgcagctggtggagtccgggggaggctggggtccaggcctggggggtccctgagactctcctgttcagcctctggattcacctttagtaggtttggatgagttgggtccgcaggctcgagggaggggcctggagtgggtggccaaacatgagtacgatgggaagtgagaaaactntgtggactccgtgagggccgattcacatctcagagacaacgacaagaatttagngtatctgctaaatgagcaagccttgagagccgaggacgcggctggtntaattntgttgcgaagtaag

SEQ ID NO: 336900 - DNA, 593 bp, Homo sapiens
  misc_feature: GZ8MTXP01CK1RC.2.81.H04.1.454.CMB.2.raw
  modified_base (222)..(222): a, c, t, g, unknown or other
  misc_feature (222)..(222): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (421)..(421): a, c, t, g, unknown or other
  misc_feature (421)..(421): n is a, c, g, or t
  modified_base (504)..(504): a, c, t, g, unknown or other
  misc_feature (504)..(504): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtntcagtgtgagtgcagctggtggagtccgggggaggctgggtccagccgtggggggtccctgagactctctgttcagcctntggnttctacctttagtaggttttggatggaggttgggtccgcgaggctccgaggggaggggcctggaggtgggtgccaaaacataaggagtacgatagggaagtaggaagaaaaactntaggtaggactccggtaggaacgggccgtagttaccaccgatcctaccgagtacgaacgaacggaacaaagtaactttaggtntatctagactaaatgaagcaagtccgagagacggaccggaggaccgacggcgtggtagttaagtttagttggacgtaaggaaggtaaag

SEQ ID NO: 336901 - DNA, 660 bp, Homo sapiens
  misc_feature: GZ8MTXP01B67O9.2.81.H04.1.454.CMB.2.raw
  modified_base (448)..(448): a, c, t, g, unknown or other
  misc_feature (448)..(448): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggtttacttgttggtatttagaaggtgtccagtgtgaggtgcagctgggtgggaggtccgggggaggcgtgggtccaggccgtggggggtccctgacgactctcctgtcagcctctggattctacctttaggtaggttttggatggtagtttcgggtcccgccgaggcgtccgagggggaacggggccgtgggaggtggggtcggaccgaaaacagtaaggagtacgagtagggaagtagaaagaaaaactntaggtaggactccggtaggaacgggacccgtattccgaacctatcctacccgaagaacgaacgaaacgaactaaagtaaattttaacggtgttaactcgtaggacctaaaagtcgaacgcgaacgccgttaggacggacgaccccgggaagggacccgacgggcgttaaggtagtttaatttaaggtggttacggtaacggaaaggtaaaag

SEQ ID NO: 336902 - DNA, 585 bp, Homo sapiens
  misc_feature: GZ8MTXP01ACMC3.2.81.H04.1.454.CMB.2.raw
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
  modified_base (561)..(561): a, c, t, g, unknown or other
  misc_feature (561)..(561): n is a, c, g, or t
  modified_base (580)..(580): a, c, t, g, unknown or other
  misc_feature (580)..(580): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtgggaggtccgggggaggctggggtccaggccgtggggggtccctgagactctcctgttcagcctctggtattctacctttagtaggttttggatggtagttgggtctcgcaggctcgagggacgggctggagtggggngaccaacgngtagagtacgagtagggaagtagaaagtaaaactgtggtacggacgtccggtaggaacggggccgattccactatcctaccgagaaggacaaacgganaaagtaatttagngtattctagactaaagtgaagcaagttccaggagacgcccggagggttcaccgggtntggttgttattgttggtgngtaag

SEQ ID NO: 336903 - DNA, 553 bp, Homo sapiens
  misc_feature: GZ8MTXP01CGE0F.2.81.H04.1.454.CMB.2.raw
  modified_base (419)..(419): a, c, t, g, unknown or other
  misc_feature (419)..(419): n is a, c, g, or t
  modified_base (458)..(458): a, c, t, g, unknown or other
  misc_feature (458)..(458): n is a, c, g, or t
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctggggtccaggccgtggggggtccctggagactctcctgttcagcctctggattcacctttagtaggttttgatgagttgggtccgccaggctccgagggaggggcctgggagtggggtggccaaacataagagtacgatggaagtgaagaaaactntgtggactccggtgaagggccgattcaccatctccaganacgaacgaacaagtaaatttagtgtatctagactaaatgagcaagccttgagngacccgnggaccncgggctgtgtaattatgttgcgaagtaag

SEQ ID NO: 336904 - DNA, 619 bp, Homo sapiens
  misc_feature: GZ8MTXP01CFJ6D.2.81.H04.1.454.CMB.2.raw
  modified_base (222)..(222): a, c, t, g, unknown or other
  misc_feature (222)..(222): n is a, c, g, or t
  modified_base (306)..(306): a, c, t, g, unknown or other
  misc_feature (306)..(306): n is a, c, g, or t
  modified_base (558)..(558): a, c, t, g, unknown or other
  misc_feature (558)..(558): n is a, c, g, or t
  modified_base (589)..(589): a, c, t, g, unknown or other
  misc_feature (589)..(589): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggtttacttgttggtatttagaagtntcagtgtgaggtgcagctggtggaggtccgggggaggcgtgggccaggccgtggggggtccctgagactctcctgttcagcctntggattctaccttttagtaggttttggattggtagtttcgggtcccgccgaggcctaccggaggggaagggggcccgtggggaggtgggggtacggacccgaaaaacagtaaggaagtaacggaagtagggaaagtaggaaagtaaaaactgtaggtaggactccggtaggaaacgggccgtattccaaccattccaccgagaacgaaccgaaacgaacaaagtaatttagtagtatctagactaaatgaancaagccttaggagacgaccgagacgcggttntgtagttaattatggttagaacgaagtaag

SEQ ID NO: 336905 - DNA, 711 bp, Homo sapiens
  misc_feature: GZ8MTXP01EFGKA.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttacttgttggtatttagagtgtcagtgtgagtgcagctggtggagtccgggggagcgtgggtccaggccgtgggggtccctgagactctcctgttcacgtcctcgtggtacttctaccgttttagttaggttttggagttggtaggttcgggtccgccgaggtccgtaccggagggggaacggggtcccgtgggaggttggggtacggacccaaaacgagtaaggagtaacgagtaggaaaggtaggaaagtaaaaacgtgttaggtacggtaccgtacccgggtagggaaacggggtccccgtaagtttacccaacccgtagtacccgtaaccgaagaaccggtaaaccgaaaaccggtaacctaaaagggttaaacttttagggtaacgttacgttaccgttaagaaccttaaaagacggtaacgtcgaaagtccccgttaggaacgacggacccgaaggttaccgcggttacgttggtacgttaatttcgtgttacggcgttaagtaaag

SEQ ID NO: 336906 - DNA, 577 bp, Homo sapiens
  misc_feature: GZ8MTXP01A5UB2.2.81.H04.1.454.CMB.2.raw
  modified_base (549)..(549): a, c, t, g, unknown or other
  misc_feature (549)..(549): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctggtggagtccgggggaggctgggtccagccgtggggggtccctgagactctcctgttcagccctctggattctacctttagtaggttttggatggtagttgggtccgcgaggctccgaggggaaggggcctgggaggtggggtgggcccaaaacgataaggagtaacgagtgggaagtgaagaaaactgtgtaggactccggtagaaggggccgattcgaccatcctaccagacgacaaacggactaaagtaagtttagtgtatctagctaaaagtgagcaagccgttaggacgagcccgagggacncggctgtgtaattgngttgngaagtaag

SEQ ID NO: 336907 - DNA, 586 bp, Homo sapiens
  misc_feature: GZ8MTXP01A4LV4.2.81.H04.1.454.CMB.2.raw
  modified_base (232)..(232): a, c, t, g, unknown or other
  misc_feature (232)..(232): n is a, c, g, or t
  modified_base (493)..(493): a, c, t, g, unknown or other
  misc_feature (493)..(493): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttactgttgtatttagaggtgtccagtgtgaggtncagctgggtggaggtccgggggaggcgtgggtccaggccgtggggggtccctgagactctcctgttcagcctctggattcacctttagtaggtttggatggagttgggtccgccaggctacgaggggaagggcctggagtgggtggccaaacagtgagtacgatgggaagtagaagaaaactatgtaggacgtccggtaggaagggaccgattccgaccatcctacaagagacgaaacgacaaaggtaatttagagtactntaggactaaatgaacgtcaagcccttggaacgacggacccggaggaccgacgggcgttaaggtgttaattagttggttcgaacggaagtaaag

SEQ ID NO: 336908 - DNA, 616 bp, Homo sapiens
  misc_feature: GZ8MTXP01DGN5A.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagcgtgggtttacttgttggtatttagaagtgtccagtgtgaggtgcagctgggtggaggtccgggggaggctgggtccaggccgtggggggtccctgagactctcctgttcagcctctggattctacctttagtaggttttgatggtaggttcgggtccgccaggccgtccggaggggacggggccgttaggggagtggggtcggaccaaaacgagtaaggagtaacgagtagggaagtagaaagaaaatatggtaggactaccggtaggaacgggaccgtattaccaccattccaccgaagacgaacaaacgaataagttaagtttagtagttactgtacgaataatagacgcgaacgacgaggacgacggacggacggacggacggttgtgttagttaagttagttggttgtaagaagtaag

SEQ ID NO: 336909 - DNA, 631 bp, Homo sapiens
  misc_feature: GZ8MTXP01DBQ6P.2.81.H04.1.454.CMB.2.raw
  modified_base (311)..(311): a, c, t, g, unknown or other
  misc_feature (311)..(311): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaagtgtccagtgtgaggtgcagctgggtggaggtccgggggaggcgtgggtccgaggccgtggggggtccctggagactctcctgttcacgcctntggtattcctaccttttaggtaggttttggattggtaggtttcgggtcccgccgaggcctaccgaggggacggggcctgggaggtggggtcgacccaaacagtaagagtacgagtaggaagtagaaagaaaactgtgtacggactccggtaggaaacgggaccgtattccgaaccatcctaccgaagaacgaacggaaacgtaactaaagttaatttagagttactctagactaaatgacgcaagccttaggacgacggaccggtaaggaccgacggttcgttggtagttaagtttagtaggttagtaacgaaggtaaag

SEQ ID NO: 336910 - DNA, 646 bp, Homo sapiens
  misc_feature: GZ8MTXP01ACQ9W.2.81.H04.1.454.CMB.2.raw
  modified_base (399)..(399): a, c, t, g, unknown or other
  misc_feature (399)..(399): n is a, c, g, or t
  modified_base (547)..(547): a, c, t, g, unknown or other
  misc_feature (547)..(547): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgaggtgcagctggtggagtccgggggaggcgtgggtccaggccgtgggggtccctgagactctcctgttcacgcctgtggattcctaccgtttaggttaggttttggatggtaggttcgggtccgccgaggctcggaggggaggggcctgggaggtgggtgacccaaanagtaaggacgtacgagtagggaagtagaaagtaaaaactgtgtaggacctacggtggaacgggccgtaattccaacctagttccaccgaagaacggaacctaaacggaacgtaaaagtagttttaaagtgtaatctaggactaaaggngaacgcgaagtccgttaggaacggaccggtaccggaaggaccgcgggttacgttaaggttaacgtttaagtttagttaggacggtaacggttaagtaag

SEQ ID NO: 336911 - DNA, 612 bp, Homo sapiens
  misc_feature: GZ8MTXP01EO5PT.2.81.H04.1.454.CMB.2.raw
  modified_base (512)..(512): a, c, t, g, unknown or other
  misc_feature (512)..(512): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctgggtggaggtccgggggaggctgggtccaggccgtggggggtccctgagactctcctgttcagcctctggattctacctttagttaggttttggattggtaggtttcggggtccgccgaggtctccggagggggaaggggccgtgggaggtggggtgacccaaaacgagtaagagtacgagtaggaagtagaagtaaaactgtagtaggactcggtaggaacgggacccgtattaccgacctatccgtaccaagaacgacaaacgtaanaaagtaatttagtagtatctagactaaatgagcaagccttagagacggacgacggacgcgggcgtggtagttaagtttgtggttagtcggttaagtaaag

SEQ ID NO: 336912 - DNA, 595 bp, Homo sapiens
  misc_feature: GZ8MTXP01E16ZM.2.81.H04.1.454.CMB.2.raw
  modified_base (224)..(224): a, c, t, g, unknown or other
  misc_feature (224)..(224): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (476)..(476): a, c, t, g, unknown or other
  misc_feature (476)..(476): n is a, c, g, or t
  modified_base (567)..(567): a, c, t, g, unknown or other
  misc_feature (567)..(567): n is a, c, g, or t
tcagacgctcgacacacgaccggtgctcgatttagtagtgtagattcgcggggctgccctttggctttggagatggttttctcgatgggggctgggaggtcccagagaggagccttagccctggactccaaggcctttccacttggtgatcagcactgagcacagaggactcaccatggaattggggctgagctgggttttacttgttggtattttagaaggtntccagtgtgaggtgcagctggtgggaggtccgggggaggctggggtccaggccgtggggggtccctgagactctcctgttcagcctctggattcacctttagtaggtttgatgagttggtccgcaggctcgaggggaagggctggagtgggnggccaanaatagngtacgagtgggaagtagaaagaaaaactgtgtaggactccggtaggaaacgggccgtaattccgaaccataccgtaccccaaggaanaaccgaaacgggaacaaaggtaaatttaagagttaatctaggacaaaagtgaagcgaaggcctaggaggaagcccgaaggacaacgggttnttagttgtattgtgagagtaagaagtaa

SEQ ID NO: 336913 - DNA, 634 bp, Homo sapiens
  misc_feature: GZ8MTXP01EBWZQ.2.81.H04.1.454.CMB.2.raw
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (529)..(529): a, c, t, g, unknown or other
  misc_feature (529)..(529): n is a, c, g, or t
  modified_base (610)..(610): a, c, t, g, unknown or other
  misc_feature (610)..(610): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagcgttgggttttacttgtttggttattttagaaggtgtccagtgtgaggtgcagctgggtgggaggtccgggggaggcgtgggccagccgtgggggtcccngagactctcctgttcagcctntgattctacctttagttaggttttggatggtaggttcgggtccgcgaggcctccggaggggaggggccgtgggaggtggggtcgaccaaacagtggagtacgagtaggaagtagaagtaaaactgtaggtggacgtcggtaggaacgggtccgtaattccaaccgtatcccgtaccaaaggaccgaaccgaaacgtaactaaagttaatttaggnttaatcgtagaactaaagtgaacgcgaaagtcccgttaggaacgacggacccgaggttaaccgacggttcttggtaagttnttaagttggacgtaagaagtaaag

SEQ ID NO: 336914 - DNA, 583 bp, Homo sapiens
  misc_feature: GZ8MTXP01DRXFR.2.81.H04.1.454.CMB.2.raw
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
  modified_base (553)..(553): a, c, t, g, unknown or other
  misc_feature (553)..(553): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggtttacttgttggtatttagaagtgtcagtgtgagtncagctggtggaggtccgggggagctgggccagccgtgggggtccctgacgactctcctgttcagcctntggattcgtactttagtaggttttggatggagttgggccgcgaggctcggaggggacggcgtggagtggggtcgaccaaaacgagtgagtaacgagtaggaagtagaaagaaaaactgtgtacggacgtcggtaggaacggccgtattaccgacacgttccaccgaaagacgaaacgaaacgaactaaagtaatttagtagttatcgtagactaaagtagagcgtaagcgttagagacgccggaagaccgnggttctgtgtaattagtgacgtgaagtaag

SEQ ID NO: 336915 - DNA, 832 bp, Homo sapiens
  misc_feature: GZ8MTXP01BNAO0.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttgtatttagaggtgtccagtgtgaggtgcagctggtggaggtccgggggaggcgtgggtccaggccgtgggggtccctggagactctcctgttcagcctcgtggacttctaccttttaggttaggttttggatggtaggtttcggggtaccgccgtagggcctaccggagggggaacgggggtcccgtggggaggtgggggtacggacccgaaaacgagtaaggacgtaacgggaagtaggggaaagttaggaaaagtaaaaaaccgtagttaggtacgggaacgttacccgggttagggaaacgggggtacccggtaaagtttacccgaaaccctaaacgttcccgttaacccgaaacgggtaaacgaaacccggaaaaacggggtaaaccctaaaacggttaaaacgtttttaaacggtagggtttaaaccttaccgttaagggtaacctaaaaaaagtttccgggaaaaggcccgtaaaacgggttccccgttaacggggtaaaggacccggggaaccccgggaaggggttaaaccccgacccgggggttacgttaagggtttacggggtttaattttaacgggtttcgggttacggtaacgggttaaacgggtttaaaaagg

SEQ ID NO: 336916 - DNA, 675 bp, Homo sapiens
  misc_feature: GZ8MTXP01B64T2.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagagactcacatggaattggggctgagcgttgggttttacttgttggtatttagaagtgtcagtgtgaggtgcagcgtgggtgggaggtccgggggaggcgtggggtccgacggccggtcggggggtccctgacgactctcctgtcacgcctctggtacttcgtaccgttttaggttaggttttggagttggtaggtttcgggtcccgaccgaggccgtaccggagggggacgggccgtggggaggtggggtcgaccaaaacgagtaaggagtacgagtagggaaagtagaaagtaaaactgtagtaggacgtcggaggaacgggtacgtacttaccgacatccgtacgaagaacgaacgtaaacgaactaaagttaagtttaagtgttaacgttcgtagaactaaagtcggaacgtacgaacgtccgttaggaacggacggacccgggaaggacgttacgggttctttaagggtagttaatttaggttcggttagaacggttaaagtaaag

SEQ ID NO: 336917 - DNA, 645 bp, Homo sapiens
  misc_feature: GZ8MTXP01AZ5Y0.2.81.H04.1.454.CMB.2.raw
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (428)..(428): a, c, t, g, unknown or other
  misc_feature (428)..(428): n is a, c, g, or t
  modified_base (509)..(509): a, c, t, g, unknown or other
  misc_feature (509)..(509): n is a, c, g, or t
  modified_base (534)..(534): a, c, t, g, unknown or other
  misc_feature (534)..(534): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttggttttacttgttggtattttagaaggtgtccagtgtgaggtgcagctgggtggaggtcgggggagcgtgggtccaggccgtgggggtccctgagactctctgttcagcctntggattctacctttagtggtttgatgtagttgggtccnccgagctccgagggagggccgtgggaggtgggtgacccaaacgagtaagagtaacgagtagggaagtagaaagaaaaactntggtaggacgtccggtaggaacgggccgtaattccaaccgtatcctaccgaagacgaacgtaaacgaacaaagtatttagngtaatcgtagaacctaaagtgacgnaacgtccgaggaacggaccggaccggaagggaccgaccgggttcgtttaagggttaaacgggtttaatttacggttacgggttaagggtaaccggttaaaggtttaaaaag

SEQ ID NO: 336918 - DNA, 677 bp, Homo sapiens
  misc_feature: GZ8MTXP01AD7AE.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaagtgtcagtgtgaggtgcagctgggtggaggtcgggggaggcgtgggtccaggccgtggggggtccctgagactctctgttcacgcctcgtggtattcctaccgttttaggttagggtttttggagttggtaggttgggtccgccgaggcgtaccggaggggaaggggccgtgggaggtggggtcggccaaaacgagtaagagtaacgagtagggaagtagaaagaaaactagtaggtaggtactcggtaggaacggggcctaattccgacctactccgtaccgagaacgaaccgaaacggaactaaagttaagttttaaggtgttaactccgttagaacgtaaaagtggaaacgctaaacggcccgttagggaaacggcgggaacccggaagggacccgttaaccgggttcgttaagggttattaagtttaagttgggttccgaacggttaagtaaag

SEQ ID NO: 336919 - DNA, 706 bp, Homo sapiens
  misc_feature: GZ8MTXP01A45F8.2.81.H04.1.454.CMB.2.raw
  modified_base (310)..(310): a, c, t, g, unknown or other
  misc_feature (310)..(310): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggttttacttgttgtatttagaagtgtcagtgtgaggtgcagctgggtggaggtccgggggaggcgtggggtccaggccgtggggggtccctggacgactctcctgttcacgcctntggtattctacctttagtggttttaggattggtgttcgggtccgcgaggctcgaggggacgggtccgtagggtaggtggggtgaccaaacgaagtaagagtaacgagtagggaaggttagaaagtaaaacttgtacggtaggtaacctcgggttaggaaacgggggaccctaagtttcccgaacctatacccgtacccaaaggaacgaaccgaaacgaacgtaaaagttaagtttaagtacgtaacgttcgtaagaaccgtaaagttacggaacgcgaacgtcccgttagggaacgacgggaaccgggtaacggaacccgttcccgggttacggttaaggtttaaggtttaactttaacgggtttggttacgggtaaccggaaaggtttaaaacgg

SEQ ID NO: 336920 - DNA, 593 bp, Homo sapiens
  misc_feature: GZ8MTXP01CXB3H.2.81.H04.1.454.CMB.2.raw
  modified_base (311)..(311): a, c, t, g, unknown or other
  misc_feature (311)..(311): n is a, c, g, or t
  modified_base (438)..(438): a, c, t, g, unknown or other
  misc_feature (438)..(438): n is a, c, g, or t
  modified_base (517)..(517): a, c, t, g, unknown or other
  misc_feature (517)..(517): n is a, c, g, or t
  modified_base (537)..(537): a, c, t, g, unknown or other
  misc_feature (537)..(537): n is a, c, g, or t
  modified_base (559)..(559): a, c, t, g, unknown or other
  misc_feature (559)..(559): n is a, c, g, or t
  modified_base (576)..(576): a, c, t, g, unknown or other
  misc_feature (576)..(576): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctgggtgggaggtccgggggaggcgtgggtccaggccgtggggggtccctgagactctcctgttcagcctntggattctacctttagtaggttttggatggtagtttcgggtccgccgaggctaccgaggggaaggggccgtgggaggtggggtggaccaaacgataagagtacgagtaggaagtagaaagaaaactntggtaggactcggtaggaaacggggccgtattcaaccgtatacctccaagacgaacaaacggaactaaagtaatttagngtatactagactaaagtgancgaagtcttaggagcgaccggngacgacggctgtagttnttagtgagtgaagtaag

SEQ ID NO: 336921 - DNA, 821 bp, Homo sapiens
  misc_feature: GZ8MTXP01AT4TT.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaagttggggctgagtcgttgggttttacttggttggttattttagaaggtgtccagtgtgaggtgcagcgtgggtgggagggtccgggggaggcgtcgggtccgacggtccggtcggggggtccctggacgtaccgtccttccgttgttccgacgtcccttcgttggtactttccgttaccgtttttaggtttagggttttaggtagttagggtacggtttccggggtcccggtaccgtacgggtccgttaccgggaaggggggtaacgggggtcccggttaggggtagggttcgggggtaccggacccgtaaaacgtaagtaaggtaaggtaaacggtaaggtaagggtaaaggtaggaaaagtaaaaacgttgtagggtacggtaacccgtcgggtaacgggaacgggtacccgttaacttcccgaaccgtactccgtaaccgaaagaaaccgaaaccggtaaacggtaaaccgtaaaaggttaaagtttttacgtaacgttaacttacggttaacgtaaaccgtaaagtacggaacgaccgtaaggtacccgttagggaaacggaccggaccgggaacgacgttaccgggttgttaaggttagtttaagtttaggtggttagtaacggttaagtaaaag

SEQ ID NO: 336922 - DNA, 628 bp, Homo sapiens
  misc_feature: GZ8MTXP01CYCIX.2.81.H04.1.454.CMB.2.raw
  modified_base (407)..(407): a, c, t, g, unknown or other
  misc_feature (407)..(407): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcttgggttttacttgttggtattttagaaggtgtcagtgtgaggtgcagcgtgggtgggaggtccgggggaggcgtggggtccgacggccggtggggggtccctggacgactcctcctgtcacgcctgtgtattctacgtttagtggtttgagtgtaggtttgggtcccgcgaggcgtacggaggggagggccgtgggaggtgggtgaccaaanagtaaggagtacgagtagggaaagtagaaagaaaactgtaggtaggacgtccggtaggaacgggcccgtattccaaccagtcctacgaagaacgaacgaaacgaataaacgtaagtttagtgtatctagactaaagtcgagcgaacgtcgttaggagacggaccggaaggaccgcggttcgttaagttagttaatttaggtgttacggtaacgaagtaaag

SEQ ID NO: 336923 - DNA, 632 bp, Homo sapiens
  misc_feature: GZ8MTXP01BCV9X.2.81.H04.1.454.CMB.2.raw
  modified_base (621)..(621): a, c, t, g, unknown or other
  misc_feature (621)..(621): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgaggtgcagctggtggaggtccgggggagcgtgggtccagccgtgggggtccctgagactctctgttcagcctcgtggtattctaccttttaggttaggttttggattggtaggtttcgggtcccgccgaggcctaccggagggggaacggggtcccgtggggaggtggggtacggacccaaaacgagtaaggagtacgagtagggaagtagaaagaaaaactgtagtggactcggtaggaacggcctagttcacctatcctaccgaagacgaacgtaaacgaacgtaaagtaagttttagagtaacgtctaggactaaagtgaacgcgaagccgttaggacgacggacccggaggacgacggttctggtagttaagttagtggttacgngttaaggtaag

SEQ ID NO: 336924 - DNA, 724 bp, Homo sapiens
  misc_feature: GZ8MTXP01B8TN8.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgttgggttttacttgttggtattttagaaggtgtccagtatgaggtgcagcgtgggtgggaggtccgggggaggcgtgggtccgaggccggtggggggtcccctggacgactctccgtgttcacgtccctcgtggtactttctaccgttttaggttaggttttggtattggtaggtttcggggtcccgccgaggtccgtaccggagggggtaacgggggtccgtggggtaggtgggggtcggaccgaaaacgagtaaggagtacgagtagggaaagtagaaagaaaaactgtaggtacggactccggtaggaaacgggccgtacttcgacctattccaccgaagacgaaaccgaaacgtaactaaagttaactttaaggtcgttactcgtaggaacctaaaaggtcggaacgccgaaggccccgttaggggaacggaccgggtacccgggaacgggaaccgttaccgggttcgttaagggtttacggttaattttaacgggttggttaccgggaagttaaaggttaaaagg

SEQ ID NO: 336925 - DNA, 606 bp, Homo sapiens
  misc_feature: GZ8MTXP01D58Z0.2.81.H04.1.454.CMB.2.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (380)..(380): a, c, t, g, unknown or other
  misc_feature (380)..(380): n is a, c, g, or t
  modified_base (540)..(540): a, c, t, g, unknown or other
  misc_feature (540)..(540): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagtcgttgggttttacttgttggttatttagaagtgtcagtgtgagtgcagcgtgggtggaggtccgggggagctgggccaggcgtgggggtccnganctctctgtcncgcctgtgattctactttagtggtttgatgtaggtcggccncgagctcggagggacgggcctgggagtgggcgaccaaaanagtaaggagtacgagtaggaagtagaaagtaaaactgtaggtaggaccgtcggtaggaaacggggtccctaagtttacccaacctagttacccaccgaaaggaacgaaaccgaaacgtaaacaaagttaagtttagagttaatctagaactaaagtgacncaacgcttggaacgacggacggaagacgacgttgttaagtgttaattagtgagtaacgaagtaaag

SEQ ID NO: 336926 - DNA, 716 bp, Homo sapiens
  misc_feature: GZ8MTXP01AN6NQ.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttgggttttacttgttggtattttagaaggtgtccagtgtgaggtgcagcgtgggtggaggtccgggggaggcgtgggtccgaggccggtggggggtccctggacgtactctcctgttcacgtccgtcgttggtactttcgtaccgttttaggttagggttttcggagttggtacgggtttcggggtacccgccgtacggccgttacccggaagggggtaacgggggtcccgtagggggtaggttcgggggtacggacccgaaaaacgtagtaaggaggtaacggtaaggtagggaaaggttaggaaagtaaaaacttgtaggtacggtaccgtacgggtagggaacggggtaccctagttaccaacctacgttccaacgacgaagaaccggaaacgtaacgtaaagtaagtttagagtatctaggactaaagtgacgcaagccgttaggaacgccggaccggaacggttacggccgggttattggtagtttaatttggttgggagtaacggaagttaaag

SEQ ID NO: 336927 - DNA, 582 bp, Homo sapiens
  misc_feature: GZ8MTXP01EPR7H.2.81.H04.1.454.CMB.2.raw
  modified_base (307)..(307): a, c, t, g, unknown or other
  misc_feature (307)..(307): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttactgttggtatttagaagtgtcagtgtgaggtgcagctgggtggaggtccgggggagcgtgggtccaggccgtggggggtccctggagactctcctgttcagccctntggattcacctttagtagtttgatgtagttgggtccgcgaggctcgaggggaggcctgggagtgggtcgaccaaaacgataaggagtacgagtaggaaagtagaaggtaaaaaactgtaggtaggactcggtagaaacgggcctagttccaaccattcaaccagaacgtaacaaggaacaaagtattagntacttnagactaanagacgcgaacgacgagagacggacggacggacgcggcgtaagtagttaagttagtgttagtaagaagtaag

SEQ ID NO: 336928 - DNA, 660 bp, Homo sapiens
  misc_feature: GZ8MTXP01CHZJI.2.81.H04.1.454.CMB.2.raw
  modified_base (446)..(446): a, c, t, g, unknown or other
  misc_feature (446)..(446): n is a, c, g, or t
tcagacgctcgacacacgaccggtgctcgatttagtagtgtagattcgcggggctgccctttggctttggagatggtttttctcgatgggggctgggaggtctcagagaggagccttagccctggactccaaggcctttccacttggtgatcagcactgagcacagaggactcaccatggaattggggctgagcttggtttacttgttggtatttagagtgtcagtgtgagtgcagctggtggaggtcgggggagcgtgggtccgagccgtgggggtccctgacgactctcctgtcagcctcgtgtattcctacgttttaggttacggttttggtattggtaggtttcgggtccgccgacggccgtcggagggggaggggccgtgggaggtcgggtcggaccgaaaacgataaggagtacgagtagggaagtagaaagaaaacgtntaggtacggactccggaggaacggggctaacgttccaacgtatccgtaccgaagaaccgaacgaaacgtaaacgtaagttaaactttaggtacgttaataccgttagaacctaaaagtggaacgtcgaacgtccgttagggaacgacgaacccggaagggaccgttacgggttcttaaggtatttaacgttagttggacgaaggttaagtaaag

SEQ ID NO: 336929 - DNA, 692 bp, Homo sapiens
  misc_feature: GZ8MTXP01DJNOU.2.81.H04.1.454.CMB.2.raw
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
tcagacgctcgacacacgaccggtgctcgatttagtagtgtagattcgcggggctgccctttggctttggagatggttttctcgatgggggctgggaggtctcagagaggagccttagccctggactcccaaggccttttcccacttggtgatcagcactgagcacagaggactcaccatggaattggggctgagtcttgggttttacttgttggtattttagaaggtntccagtgtgaggtgcagtcgtggtgggaggtcgggggngcgtgggtccgaggccgtgggggtccctgacgtacgtcttccgtgtcgacgtcctgtggtactttcctaccgttttaggttacggttttggagttggtacggtttcgggtcccgccgaggtccgtaccggaagggggacggggtccgtggggaggttggggtacggacccaaaacgagtaaggagtaaccggagtagggaaagtaggaaagtaaaactgtaggtacggtacgtaccgggtaggtaaacgggtccgtacttccaaccgtactacccgtaccgaaagaaccgaaaccggaaacgtaacgtaaaagttaagtttaagtagttacgttcgtaagtactaaaagtcgaagtcgaacgtcgttaggacggacgacggaacggcgacggttcgtgtacgttaagttgtggagtgaagtaaag

SEQ ID NO: 336930 - DNA, 584 bp, Homo sapiens
  misc_feature: GZ8MTXP01BFZSL.2.81.H04.1.454.CMB.2.raw
  modified_base (414)..(414): a, c, t, g, unknown or other
  misc_feature (414)..(414): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattgggggctgagctgggttttacttgttggtattttagaaggtgtccagtgtgaggtgcagctggtggagtccgggggaggctgggtccagccgtggggggtcccctgagactctcctgttcagcctctggattcacctttagtaggtttggatgagttgggtccgcaggctccgagggaagggcctggagtgggtgccaaacatgagtacgatgggaagtgaagaaaaactntgtggactccggtaggaagggcccgagttccaccatcctaccagacggacaaacgaacaaagtaaactttagtcgttatccttagactaaagttgacgcaagcccttaggacgaggacccggagggaacgcgggctggttgtaagtttagtggttagccgttaagtaaag

SEQ ID NO: 336931 - DNA, 661 bp, Homo sapiens
  misc_feature: GZ8MTXP01B44OI.2.81.H04.1.454.CMB.2.raw
  modified_base (287)..(287): a, c, t, g, unknown or other
  misc_feature (287)..(287): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttggtttacttgttggtatttagagtgtcagtgtgaggtgcagctggtggaggtccgggggaggcgtgggtccaggccgtggggggtccctggngactctctgttcacgtcctctggattctacctttaggttaggttttggattggtaggtttcggggtcccgccgaggcctacgagggggaaggggcccgtggggaggtggggtcggaccaaaacgacgtaaggagtacgagtagggaagttagaaagaaaactgtaggtaggactcggtagaacggggtacctattccaaccgtattaccaaccgaagaacgaaccgaaacgtaacgtaaaagttaaagttttaagtaggttactacgttacggaaactaaagtcggaacgcgaaacggtccgttagggacgacggacccggagggttaacgcgggttacttggtagtttaagttagtggttacgaagaagtaag

SEQ ID NO: 336932 - DNA, 668 bp, Homo sapiens
  misc_feature: GZ8MTXP01CBC2X.2.81.H04.1.454.CMB.2.raw
  modified_base (628)..(628): a, c, t, g, unknown or other
  misc_feature (628)..(628): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtctgggtttacttgttgtatttagaaggtgtccagtgtgaggtgcagcgtgggtgggaggtccgggggaggcgtgggtccgaggccggtcggggggtccctggacgtactcctccgtgttcgacgtccctcgttggtactttcctacccgttttaggttagggtttttaggtagttggtaggtttcggggtcccgccgacggccgtccggaagggggaacggggtcccgtggggaggtggggtcggaccaaaacgagtaagagtaacgagtaggaagtagaaagtaaaactgtgtggactcggtagaacgggctagttccaccacgtctaccgaagaacgaacgaaacgaacgtaaagttaagtttagtacgttatacgtagaactaaagtgaacgcgaacgtccgttaggacgacggaccgggagaccgcggttnttgttagttaagtttgtggttaggaacgttaaaggtaaag

SEQ ID NO: 336933 - DNA, 606 bp, Homo sapiens
  misc_feature: GZ8MTXP01BTH7B.2.81.H04.1.454.CMB.2.raw
  modified_base (225)..(225): a, c, t, g, unknown or other
  misc_feature (225)..(225): n is a, c, g, or t
  modified_base (409)..(409): a, c, t, g, unknown or other
  misc_feature (409)..(409): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtctgggttttacttgttggtattttagaaggtntccagtgtgagtgcagctgggtggaggtccgggggagctgggccaggccgtggggggtccctgagactctcctgttcagcctctggattcaccgttttagtaggttttggatggtagtttgggtacccgccgaggcctaccggagggggaacggggcctggggaggtggggtcgaccgaaaacntaagacgtaagagtaggagtagaaacgtaaaaactgtggtaggacgtccggtaggaacggggcccatttcacccattccaaccgagacggaacaacgaactaaaggtaattttagactattccaggacaaatagagcgaacgccgagagagacggacggacgacggcgtgtgttaagttattgttagtgaagtaaag

SEQ ID NO: 336934 - DNA, 726 bp, Homo sapiens
  misc_feature: GZ8MTXP01CFHUR.2.81.H04.1.454.CMB.2.raw
  modified_base (310)..(310): a, c, t, g, unknown or other
  misc_feature (310)..(310): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttgggttttacttgttggttatttagaaggtgtcagtgtgaggtgcagcgtgggtgggaggtcgggggagtcgtgggtcaggccggtgggggtccctgacgactctcctgttacncgtcctgtggtacttctaccgtttagttaggttttggagtggtaggtttcgggtcccgccgtacggtcctaccggagggggtaacggggtcccgtaggggacggtcggggtcgaacccgtaaaacgagtaaggagtaacggtagtagggaaagtaggaaacgtaaaaattgtaggtacggacgtcggtaggaacggggacctagttcacgtacgtcctaccgagaacgtaacggaaacgtaaacgtaagttaaactttagggtatactacgtacgtaactaaagtcggacgtacgaacggttaccgagggaaaccgcggggtaaacccgacggggaaaccgttcccggggttcgttaaggtttaacggtttaactttagggttaccggggagtaaaccggaagggtttaaaaaacg

SEQ ID NO: 336935 - DNA, 725 bp, Homo sapiens
  misc_feature: GZ8MTXP01AD91L.2.81.H04.1.454.CMB.2.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttgtattttagaggtntcagtgtgaggtncagcgtgggtgggaggtccgggggaggcgtggggtccgaggccggtggggggtccctggacgactctcctgttcacgcctgtggacttctaccgttttagtaggttttggatggtaggttcgggtcccgcgaggctaccggagggggaacggggccgtggggaggtggggtacggacccaaaacgagtaaggagtacgagtagggaagtaggaaagtaaaactgtaggtacggacgttaccggtaggaacggggtacccgtacttaccgaaccgtacttacccgtaccgaaggaacgaaaccgaaacggtaaactaaaggttaaagttttaagtggttaacttccgttaagaaccgtaaagtaggaacgccgtaacggtcccgttaagggaacggaaccgggtacccgggaaacggggaccgttaccggggttccgttaagggtttacgtttaagtttacggttggttacggtaacggaaaggttaaag

SEQ ID NO: 336936 - DNA, 623 bp, Homo sapiens
  misc_feature: GZ8MTXP01BW6XU.2.81.H04.1.454.CMB.2.raw
  modified_base (310)..(310): a, c, t, g, unknown or other
  misc_feature (310)..(310): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
  modified_base (616)..(616): a, c, t, g, unknown or other
  misc_feature (616)..(616): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggttttacttgttggtattttagagtgtccagtgtgaggtgcagctgggtggaggtccgggggaggcgtggggtccaggtccggtggggggtccctggagctctctgtcacgcctntggattctacgttttagttaggtttgatggtaggttcgggccgtccgaggcctaccggagggggacggggccgtggggaggtcggggtcgaccaaaacgagtaagaaggtacgaagtggaaagtaggaaacgtaaaactgtggtacggaaccgtccgggtaggaaacgggccgtaatttaccacctagttccaaccgagaacgaccaaacggaactaaaggttaatttagtgtactcgtagataaagtgaacgcaagccttaggagcgaccggaggttaccgcggttntaagtgttntgtgttagngaagtaa

SEQ ID NO: 336937 - DNA, 638 bp, Homo sapiens
  misc_feature: GZ8MTXP01C16AV.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtattttagaaggtgtcagtgtgagtgcagctgggtggaggtccgggggaggcgtggggtccaggccgtcggggggtccctggagctctcctgttcagccctgtgattctaccgtttagtaggttttgagtggtaggttcgggtccgcgaggctcggaggggaggggccgtgggaggtggggtacgaccgaaaacagtaagagtaacgagtaggaagtagaagaaaactgtgtaggactccggagaacgggctagttccaccgtatccgtacgagaacgaacgaaacgtaacgtaaagtaatttaggtatagttactaggaacctaaagtgacgactcggacccgttaggaacgaccgggaaccggagggaaaccgttcggggttacttggttagttgtttaaggtggttaggtaacgaagttaaaag

SEQ ID NO: 336938 - DNA, 645 bp, Homo sapiens
  misc_feature: GZ8MTXP01CMVGB.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaagtgtccagtgtgaggtgcagctgggtggaggtccgggggaggcgtgggtccaggcctggggggtcccctgagactctcctgtcagcctctggattctacctttagtaggttttgatgtagttgggtccgcgagcgtccgagggaaggggcctgggacgtggggtggcccgaaaacagtaagagtacgagttagggaagtagaaggaaaaactagtggtaggacgtccggtaggaaacggggtcccggatttccgaaccattccgtaccaagacgaacgaaacggtaaccaaaggtaaatttagtagtattaccgttggactaaagtcgaacgcaagcccgttaggaacggacggaccccggaaggacccgaccgggttcttaagggtagttaagttttaagttggttaggccggttaaaggtaaag

SEQ ID NO: 336939 - DNA, 690 bp, Homo sapiens
  misc_feature: GZ8MTXP01AUY4U.2.81.H04.1.454.CMB.2.raw
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggccctttccattggtgatcagcactgagcacagaggactcaccatggaattggggctgagtcttggtttacttgttgtatttagagtgtcagtgtgaggtgcagcgtgggtgggaggtccgggggngcgtgggccaggccggtgggggtccctgagctctctgtcagtcctntgtnttcctacgtttaggtaggtttgatggtaggttcgggtcccgcgaggccgtaccggagggggtacgggccgtaggggtaggtgggggtacgacccaaaagagtaagaagtacgagtagggaagtaggaaaagtaaaactgtacggtaggaccgtacgggtaggaacgggtaccgtacgttaccaaccgtatacccgtaaccgaaagtaaccgaaaccgaaaacgtaaacgtaaagtttaaagtttaagtgttaacttacgtaaggaacctaaaagtcggaacgacgaacgtcccgaggaacggaccggaaccgggaaggaacccgttaccgggttcgttaaggttacgttaagtttaggtggttacggtaaggaagttaaaag

SEQ ID NO: 336940 - DNA, 661 bp, Homo sapiens
  misc_feature: GZ8MTXP01B3AYZ.2.81.H04.1.454.CMB.2.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (560)..(560): a, c, t, g, unknown or other
  misc_feature (560)..(560): n is a, c, g, or t
  modified_base (624)..(624): a, c, t, g, unknown or other
  misc_feature (624)..(624): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttacttgttggtattttagaagtgtccagtgtgaggtncagctgggtgggaggtccgggggaggcgtggggtccaggcccgtggggggtcccctgagactctcctgtcagccctntggtacttcgtaccttttaggttaggttttggattggtaggtttcgggtcccgccgaggtccgtaccggaagggggaacgggggtcccgttaggggaggtggggtcgggacccaaaacgagtaaggagtaacgagtagggaagtaggaaagtaaaaactgtagtagggacctcggtagaacggggcccgtattaccgacctagtcctaccgaagaacgaacgaaacggaacgtaaagtaactttaggnttaagtcgtagaactaaagtgaacgcaacgtccgttaggacgcgaccggaggacgttccggttntaagttgttaagttgtaggttcgaacgttaaggtaag

SEQ ID NO: 336941 - DNA, 614 bp, Homo sapiens
  misc_feature: GZ8MTXP01BIZYU.2.81.H04.1.454.CMB.2.raw
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
  modified_base (561)..(561): a, c, t, g, unknown or other
  misc_feature (561)..(561): n is a, c, g, or t
  modified_base (585)..(585): a, c, t, g, unknown or other
  misc_feature (585)..(585): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggttttacttgttgtatttagaggtgtccagtgtgagtgcagctgggtggaggtccgggggaggcgtgggtccaggccgtgggggtccctgagctctctgttcacgtcctctggtacttcgtaaccgttttaggttaggttttggattggtagtttcgggtccgccgaggtcctccgagggggaaggggcccgtggggagtggggtacggaccaaaacgagtaaggaggtaaacgagtagggaaagtaggaaagaaaactgtaggtaggaacgtcggtaagaacggggacgtattccgacctattccgacaagaacgacgaaacgaacgtaagtaatttaagngttaancgtagactaaagtcgaancaacgtccagagcgaccgagacgnggctgtgttaattgtgttgaagaagtaag

SEQ ID NO: 336942 - DNA, 586 bp, Homo sapiens
  misc_feature: GZ8MTXP01AB70J.2.81.H04.1.454.CMB.2.raw
  modified_base (219)..(219): a, c, t, g, unknown or other
  misc_feature (219)..(219): n is a, c, g, or t
  modified_base (299)..(299): a, c, t, g, unknown or other
  misc_feature (299)..(299): n is a, c, g, or t
  modified_base (535)..(535): a, c, t, g, unknown or other
  misc_feature (535)..(535): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttactgttgtatttagaagtntccagtgtgagtgcagctggtggaggtccgggggagctgggtccagccgtgggggtccctgagactctcctgtcagcctntggattcacctttagtaggttttggatgtaggttgggtccgcgaggctccgaggggacggggcctgggagtggggtgccaaacgataagagtacgagtagggaagtgaaagtaaaactgtggtaggtactccggtaggaacgggccgtattccaccgtattccgtaccaagaacgaaccgaaacgaacgtaaagtaatttagtagtatcgtagactaatgagctaagcttagacgnggaccgacggacgacgggcttggtagtaatttagtggcgtaacgaagtaag

SEQ ID NO: 336943 - DNA, 694 bp, Homo sapiens
  misc_feature: GZ8MTXP01BREAO.2.81.H04.1.454.CMB.2.raw
  modified_base (222)..(222): a, c, t, g, unknown or other
  misc_feature (222)..(222): n is a, c, g, or t
  modified_base (314)..(314): a, c, t, g, unknown or other
  misc_feature (314)..(314): n is a, c, g, or t
  modified_base (392)..(392): a, c, t, g, unknown or other
  misc_feature (392)..(392): n is a, c, g, or t
tcagacgctcgacacacgaccggtgctcgatttagtagtgtagattcgcggggctgccctttggctttggagatggttttctcgatgggggctgggaggtctcagagaggagccttagccctggacctccaaggcctttccacttggtgatcagcactgagcacagaggactcaccatggaattggggctgagcttggttttacttgttgtatttagaggtntcagtgtgaggtgcagctgggtgggaggtccgggggaggcgtggggtccgaggccggtggggggtccctggacgactctcctgttcagcctntggtattctactttagttaggttttggatggtaggttcgggtccgccgaggcctacggaggggacggggccgtggggnggtggggtcgaccaaacgagtgagtacgagtggaagtagaaagaaaacgtgtaggtggaccgtccgggtaggaacggggtacctattacccaaccgtactacccgtaccgaaaggaacgaaaccggaaaccgtaaacgtaaaaggttaaacgttttaacggtagttaacttaccgtaacggaactaaaagttcggaacgcgaacggtacccgttaggaaacggaccggacccggtaagggacccgccgggttacgtttaaggtaggtttaactttaggtggttacggtaacgaaaggtaaag

SEQ ID NO: 336944 - DNA, 682 bp, Homo sapiens
  misc_feature: GZ8MTXP01EM47H.2.81.H04.1.454.CMB.2.raw
  modified_base (233)..(233): a, c, t, g, unknown or other
  misc_feature (233)..(233): n is a, c, g, or t
  modified_base (341)..(341): a, c, t, g, unknown or other
  misc_feature (341)..(341): n is a, c, g, or t
  modified_base (639)..(639): a, c, t, g, unknown or other
  misc_feature (639)..(639): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagagtgtccagtgtgagtncagctggtggaggtccgggggagctgggccagccgtgggggtccctgacgactctcctgttcagcctgtgattcacctttagtaggtttgatggtaggttcgggtccnccgtaggctccggaggggaacggggtccgtgggaggtggggtcggaccaaaacgataaggagtacgagttagggaagtagaaagaaaactgtggtaggtacctcggtaggaacgggtacccgtagtttaccaccgattccgtaccgaaagaacgaaccggtaaacgaaacgtaaagttaaacgtttagtagtaaagttccgtaaggtaacctaaaaggttcgaaacgcgaacggtacccgttagggaaacggaccgggaccggaagggttaccccgacggggttacttaaggggtttntttaaacgtttagttgggttaccgaacggttaaaggttaaagg

SEQ ID NO: 336945 - DNA, 637 bp, Homo sapiens
  misc_feature: GZ8MTXP01ED6VD.2.81.H04.1.454.CMB.2.raw
  modified_base (238)..(238): a, c, t, g, unknown or other
  misc_feature (238)..(238): n is a, c, g, or t
  modified_base (565)..(565): a, c, t, g, unknown or other
  misc_feature (565)..(565): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgttgggttttacttgttggtattttagaggtgtcagtgtgaggtncagctgggtgggaggtccgggggaggcgtggggtccaggccgtggggggtccctggacgactctcctgttcagcctctggattcctaccgttttaggttaggttttggattggtaggtttcgggtcccgccgaggcctaccggagggggaacggggtcctggggtaggtggggtcggacccaaaacgagtaaggagtacgagtaggtaagtagaaagtaaaactgtggtaggacgtcggtaggaacggtaccgtattaccacagttccacagacaacggaaaccgataaagttagtttagtagttactacgtagaactaaagtgacncgaacgccgttaggacgacggccggaacgacgcggttcttggttagtaatttgtggagtaacggaagtaaag

SEQ ID NO: 336946 - DNA, 642 bp, Homo sapiens
  misc_feature: GZ8MTXP01D5THO.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtattttagaaggtgtccagtgtgaggtgcagctggtggaggtcgggggagcgtgggtccaggccgtgggggtccctgagactctcctgttcagcctcgtggtacttctaccgtttaggtaggttttggatgtaggttcgggtcgcgaggctcgagggaggctggagtgggtcgacaaacataagagtacgagtaggaagtagaaagtaaaactgtaggtaggactccggtagaacgggtcctagttcaccgtatcctaccgaagtacgaaacgaaacgaacgtaaagttaactttaggtagtaactccgtaagaactaaaagttggacgtcaacggtcccttagggacggaacgaccgggaacggaccgaaccggggttcgttaaggttacgtttaagtttacggttcggttacggtaacggttaagtaag

SEQ ID NO: 336947 - DNA, 620 bp, Homo sapiens
  misc_feature: GZ8MTXP01CFLF0.2.81.H04.1.454.CMB.2.raw
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttggtttacttgttggtatttagaaggtgtccagtgtgaggtgcagctgggtggaggtcgggggaggcgtgggtccaggccgtggggggtccctgagactctctgtcngcctntgtacttctacctttagtaggttttggatggtaggttcgggtccgcgaggctacggaggggaaggggccgtgggaggtggggtgaccgaaacgataaggagtacgagtagggaagagaaagaaaactgtagtcggtaactcggtaggaacgggtctacttaccacctatcctacgaagtacaaacggaaacgtaactaaagttaatttagtagtagtactaggactaaagtgagcaacgtccgttggaacggcggaaccggaggaccgcgggttacgttgtaggtttaagttagttggacgtaaggaagtaaag

SEQ ID NO: 336948 - DNA, 614 bp, Homo sapiens
  misc_feature: GZ8MTXP01CK8BR.2.81.H04.1.454.CMB.2.raw
  modified_base (445)..(445): a, c, t, g, unknown or other
  misc_feature (445)..(445): n is a, c, g, or t
  modified_base (538)..(538): a, c, t, g, unknown or other
  misc_feature (538)..(538): n is a, c, g, or t
  modified_base (565)..(565): a, c, t, g, unknown or other
  misc_feature (565)..(565): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctggtggaggtccgggggaggcgtgggtccaggccgtggggggtccctgagactctcctgttcagcctctggattctaccgttttaggtaggttttggattggtagtttggggtcccgccgaggctccgagggggaaggggccgtgggaggtggggtcgaccgaaaactagtaagagtaacgagtggaaagtagaaagaaaactntaggtggactccggtagaacggggccctaattccaacctatcctacccgaagaacaaccgaaacggaaactaaagtaatttagcgtaatcgtnactaaatggaagcaagcgttgaacggngaccgaggacgcgggttctggtgttaattagttggagtgttaaggtaaa

SEQ ID NO: 336949 - DNA, 608 bp, Homo sapiens
  misc_feature: GZ8MTXP01BCPMZ.2.81.H04.1.454.CMB.2.raw
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (511)..(511): a, c, t, g, unknown or other
  misc_feature (511)..(511): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctgggtggaggtccgggggaggctgggtccgaggccgtggggggtccctgacgctctcctgttcngcctntggattctactttagtaggtttggatggagttcgggccgcgaggctccgagggggaggggccgtggggagtggggtcgccaaaacgatgagtacgagtggaagtgaaagaaaactgtagtgggactccggaggaaacggggccctagttaccaaccgattcctaccgagaacgaacggaaacgaacaaagtaactttagngtatcgtagactaaatcggagcaaggccttaggagcggacccggaaggaccgacgggttctaaggtgttaacttagtgttaggaagttaaggtaaag

SEQ ID NO: 336950 - DNA, 607 bp, Homo sapiens
  misc_feature: GZ8MTXP01CRMZL.2.81.H04.1.454.CMB.2.raw
  modified_base (326)..(326): a, c, t, g, unknown or other
  misc_feature (326)..(326): n is a, c, g, or t
  modified_base (498)..(498): a, c, t, g, unknown or other
  misc_feature (498)..(498): n is a, c, g, or t
  modified_base (527)..(527): a, c, t, g, unknown or other
  misc_feature (527)..(527): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttggtttacttgttggttatttagaaggtgtcagtgtgaggtgcagcgtgggtgggacgggtcgggggagcgtcggggtccgagggtccggtcggggggtccctggacgtactcgtcctgtccacgtcctntggtacttctacgttttaggtaggttttggagtggtagtttcgggtccgccgtaggccgtccggagggggaggggtccgtggggaggtggggtacgaccgaaactagtaagagtaacgagtaggaagtagaaagaaaactgtaggacgtacgcggtaggacggctatccacntcacgagacgacaagagtaataattagtnatgtacgataagngtagngcgcttaggagcgtaacggngacgcggnttgtattaagttgtggttagaacgttaagtaaag

SEQ ID NO: 336951 - DNA, 627 bp, Homo sapiens
  misc_feature: GZ8MTXP01AVD28.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttactgttgtatttagaggtgtcagtgtgaggtgcagcgtggtggaggtccgggggaggcgtgggtccaggccgtgggggtccctgacgactctcctgtcagcctctggattcctaccgtttaggttaggttttggagttggtaggtttcgggtcccgtccgaggtccgtcggaaggggaaggggccgtagggaggtcggggtcggaccaaacgagtaagagtacgagtaggtaagtagaaagtaaaacgtgtgtaggaacgttcggaggaacgggtaccgattccacctagtcctaccgaagaacgtaacgaaacgtaactaaagttaatttagtgtactactagactaaatcgagcgaagtcgaggacgacgaccggaagacgcggttcttggtattaagtttacgtggttagtaaccgaaggtaaag

SEQ ID NO: 336952 - DNA, 612 bp, Homo sapiens
  misc_feature: GZ8MTXP01BIPVI.2.81.H04.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (531)..(531): a, c, t, g, unknown or other
  misc_feature (531)..(531): n is a, c, g, or t
  modified_base (571)..(571): a, c, t, g, unknown or other
  misc_feature (571)..(571): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttggttttacttgttgtatttagagtgtcagtgtgagtgcagctgggtggaggtccggggagcgtgggcnggccgtggggtcccngagctctcgtgttcacgtcctgtgtattctactttaggttagtttgagtgtaggttcggtccgcgaggctcggaggggacgggccgtgggaggtgggtcgaccaaacgagtaaggacgtacggagtagggaagtagaaagtaaaactgtagtaggacgtcgtaggaacgggtaccattacgacctagcctacgaagacgaacggaaacgtaacgaaacgttaagtttacgtagtactgtacgaactaaagngaacgtacaacgccgttaggaacgcgaccggaagacccgngttacgttgttacgttaatttaggtgacggtaagaagtaag

SEQ ID NO: 336953 - DNA, 682 bp, Homo sapiens
  misc_feature: GZ8MTXP01BUZHB.2.81.H04.1.454.CMB.2.raw
  modified_base (303)..(303): a, c, t, g, unknown or other
  misc_feature (303)..(303): n is a, c, g, or t
  modified_base (483)..(483): a, c, t, g, unknown or other
  misc_feature (483)..(483): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccagtggaattggggctgagtcgttggttttacttgttgttatttagaggtgtccagtgtgaggtgcagcgtggtggaggtccgggggagcgtgggccaggccggtcgggggtccctgagctctctgtcngcctgtggtacttcgtacgttttaggtaggttttgagttggtaggttcggtccgcgtaggcgtaccggaggggacggtcgtggaggtggacgaccaaacagtaagagtacgagtaggaagtacgaaagtaaaactgtaggtacggacgtcggtaggaacggtcccgtattaccgaacctnttacccacgaagaaaccgtaacgaaaccgtaaagtaaagttaacgtttagtacgtactacggttacgaaactaaaggttcaacggtccgaaacggtccgttagggaaacggaccgggaccgggaacgggaaccgttccgggttagttaaggtttaagtttcgttttaacggtgggttacggtaacgttaaggttaaaag

SEQ ID NO: 336954 - DNA, 629 bp, Homo sapiens
  misc_feature: GZ8MTXP01A24JZ.2.81.H04.1.454.CMB.2.raw
  modified_base (564)..(564): a, c, t, g, unknown or other
  misc_feature (564)..(564): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggccctttccacttggtgatcagcactgagcacagaggactcaccatggaattggggctgagcgttgggttttacttgttggtatttagaaggtgtccagtgtgaggtgcagcgtggtggaggtccgggggaggcgtgggtccgaggccggtggggggtccctggagactcctcctgtcagcctctggtattctaccgtttaggttaggttttgagtgtaggttcgggtccgccgaggcctacggaggggaggggtccgtgggtaggtgggtcggaccaaacgagtaaggagtacgagtagggaagtagaaagtaaaactcgtagtacggacgtccgtaagggaacggtccgaattcccaccgtactccgtaccgaagaacgaacgaaacgaactaaagttaacgtttagtagtatcgtagactaaagtcgaancgtaagcgttaggacgacggacggaagacgcgcgtaagtgtaagttagttggagtcgaaggtaag

SEQ ID NO: 336955 - DNA, 667 bp, Homo sapiens
  misc_feature: GZ8MTXP01CARX4.2.81.H04.1.454.CMB.2.raw
  modified_base (561)..(561): a, c, t, g, unknown or other
  misc_feature (561)..(561): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagcttgggtttacttgttggtatttagaagtgtccagtgtgaggtgcagctgggtggaggtccgggggagcgtgggccaggccgtgggggtccctgagactctccgtgttcagtcctcgtggtactttcctaaccgttttaggttaggttttgagttggtaggtttcgggttcccgccgtaggccgtaccggagggggaacggggtccgtaggggaggtcggggtacggaccctaaaacgagtaaggacgtaacgaagttagggaagtaggaaacgaaaaacttgtggtaggactaccgggtaggaaacgggccgtaacgttcaaccattccgaccaagacgaacaaacggactaaagtaactttaggtntatctagactaaatgaacgcgaacgcgttagggaacgacgggacccggaaggaaccgcggttacgttggttacggttaattagttggacgaaggttaaggtaaaag

SEQ ID NO: 336956 - DNA, 655 bp, Homo sapiens
  misc_feature: GZ8MTXP01ANNL9.2.81.H04.1.454.CMB.2.raw
  modified_base (592)..(592): a, c, t, g, unknown or other
  misc_feature (592)..(592): n is a, c, g, or t
  modified_base (627)..(627): a, c, t, g, unknown or other
  misc_feature (627)..(627): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttgggttttacttgttaggttattttagaaggtgtccgagtgtgaggtgcgagcgtgggtgggaggtccggggggagcgtgggtccgacggtccgtcggggggtcctggacgtacctctcctgttccacgtcctcgtggtacttcttacgtttaggttaggttttggagttggtaggtttcgggtcccgacgacggtccgtacggagggggaacgggtcgtgggaggtggggtacgacgtaaacgataacggagtacgagtagggtaagtaagaaagtaaaactgtagtacggtacgtcggtaggaacggacgtacttccaacgacttccgaacgaagacgaaactaacggaaacgtaagttaacgtttataggtactatacggaactaaagtcgancgaacgtcgttaggacgacgaccggagacgcgttnttgtagtaacttgtggactggaataaag

SEQ ID NO: 336957 - DNA, 608 bp, Homo sapiens
  misc_feature: GZ8MTXP01BJJ2A.2.81.H04.1.454.CMB.2.raw
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (527)..(527): a, c, t, g, unknown or other
  misc_feature (527)..(527): n is a, c, g, or t
tcagacgctcgacacacgaccggtgctcgatttagtagtgtagattcgcggggctgccctttggctttggagatggttttctcgatgggggctgggaggtctcagagaggagccttagccctggactcccaaggcctttccacttggtgatcagcactgagcacagaggactcaccatggaattggggctgagtcgttggttttacttgttggttatttagagtgtcagtgtgaggtgcagcgtggtggagtcggggagcgtggcngcgtggggtcctgagctctctgtcngcctntgnttctacgtttagttaggtttggatggtaggttcgggtccgcgaggccgcgaggggagggccgtgggaggtgggtcgaccaaacataaggagtacgagtaggaagtagaaagtaaaactgtagtacggactacggtaggaacgggccctattaccacctatcctaccgaagtaacgaaccgaaacgtaacgtaaagttaaagtttagacgttatcgtaagacttaaagngacgcgaacgtccaggaacgcggaccggaaggttaccgacggttgtaagttgttaatttagtgttacgtaagaagttaaag

SEQ ID NO: 336958 - DNA, 573 bp, Homo sapiens
  misc_feature: GZ8MTXP01EO8QU.2.81.H04.1.454.CMB.2.raw
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
tcagacgctcgacacacgaccggtgctcgatttagtagtgtagattcgcgggctgccctttggctttggagatggtttctcgatggggctgggaggtctcagagaggagccttagccctggactccaaggcctttccacttggtgatcagcactgagcacagaggactcaccatggaattggggctgagcggtcgtttaggtcgtaaggtgttacgaagttaggtcagtgtgagtgcngngngtgngcggngngngcgngcgtggtcgngngctctctgtcgcgctcgtgtntctcgttagtgttgtagtgtgtcgtcgtcgcgcgtcgaggaggcgtggaggtggtcgacgaaacgagtgagtagagtagtaagtaagaagtaaacgtagtagtacggtacgtacgtacggacggtacgtacgtactacgacgtactacgacgaacgaacgaacgtaacgtaaagtaagttagtagtagtacgtagtagtagtacgtacgagaacgtcgttagacgacgacggacgacgcgttacgtgtagttaagttagtagttacgtaacgttaagtaag

SEQ ID NO: 336959 - DNA, 653 bp, Homo sapiens
  misc_feature: GZ8MTXP01C3NCO.2.81.H04.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagacgctcgacacacgaccggtgctcgatttagtagtgtagattcgcggggctgccctttggctttggagatggttttctcgatgggggctgggaggtctcagagaggagccttagcccctggactcccaaggccctttccacttggtgatcagcactgagcacagaggactcaccatggaattggggctgagtcttgggttttacttgttggttatttagaaggtntccagtgtgagtgcagngtggtggaggtcgggggaggcgtgggtccaggccggtcgggggtccctgacgtctctcctgttcagtcctgtggtattctacgtttagttaggttttagagtggtggttcgggtcccgccgtacggtccgtaccggaggggacggggtccgtgggagggtggggtacgaccgaaaacgtagtaaggagtaacggagtagggaaagtagaaagtaaaactgtaggtacggacgtcggtaggaaacggggccgtaacttaccacctacttcctacgaaacgaacgaacgaaacgaacgtaaagttaatttagtagtactacgtagactaaagtgacgcgaacgacgttgggagacggaccggaggacgttcggagttgtagttaagttgtggttacgaagaagttaaag

SEQ ID NO: 336960 - DNA, 679 bp, Homo sapiens
  misc_feature: GZ8MTXP01CN1AV.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagagactcacatggaattggggctgagtcgttgggttttacttgttggttatttagaaggtgtccagtgtgaggtgcagcgtgggtgggaggtcgggggagcgtgggtccaggccggtcggggggtccctgagtctctcctgtcacgtcctgtggtacttcgtaccgttttaggttaggtttggagtggtaggtttcgggtccgacgaggtccgtacggaggggtaacggggccgtaggggaggtcggggtacgaccgaaaactagtaacgaggtaacgagtaggaaagtagaaagaaaactgtagtaggacgttacggaggaaacggggtcctaacgttccaaccgtactaccgtaccgaagtaacgaaacgaaacgtaaacgtaaagtaatttagacgttatacgtagaactaagtagaacgtcgaacgtccgttaggaacggaccggaacgtacgggaaccgttccggttagttaagttgttaagttagttggacgtaacggaaggttaaaag

SEQ ID NO: 336961 - DNA, 591 bp, Homo sapiens
  misc_feature: GZ8MTXP02GMSDM.2.81.H04.1.454.CMB.2.raw
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagacgctcgacacacgaccggtgctcgatttagtagtgtagattcgcgggctgccctttggctttggagatggttttctcgatgggggctgggaggtctcagagaggagccttagcccctggactccaaggcctttccacttggtgatcagcactgagcacagaggactcaccatggaattggggctgagcggtggtttacgtgttaggtatttagaagtgtccagtgtgaggtgcagctggtggagtccggggaggcgtgggtcgacgcggtcggggtccgtgagactctcgtgtcncgcctcgtgtattctacgtttagttaggtttggtagtgtggttcggtccgcgcggcgtcgagggagggcgtggnggtggtggacgaacagtgagagagtagaagtagaaagaaaataagtagtaggacgtacggtaggaggacgtacgtacaccactaccgtaccgaagaacgaaacgaaacgaaacgaaagtaaagttaagtagtagtactagtaactaaagtagagacgacgacgtagacgacgacgacggacgacgtacgtgtagttagttagttagtagacgagaag

SEQ ID NO: 336962 - DNA, 531 bp, Homo sapiens
  misc_feature: GZ8MTXP02FX0TY.2.81.H04.1.454.CMB.2.raw
  modified_base (409)..(409): a, c, t, g, unknown or other
  misc_feature (409)..(409): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtgggttttactgtggtatttagaaggtgtccagtgtgaggtgcagctggtggagtccggggagctgggtccagcctgggggtccctgagactctcctgttcagcctctggattcacctttagtaggttttggatgagttgggtccgcaggctccgagggaggggcctgggagtggggtggccaacgatagagtacgatggaagtgaagaaaactntgtggactcgtagaagggccgattcaccatcctccagagacaacgacaagtaatttagtgtatctgacaatagagcacgctgagagacgacgacgacgcgtgtgtagttattgtgcgagaag

SEQ ID NO: 336963 - DNA, 541 bp, Homo sapiens
  misc_feature: GZ8MTXP02I2EDW.2.81.H04.1.454.CMB.2.raw
  modified_base (367)..(367): a, c, t, g, unknown or other
  misc_feature (367)..(367): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagcgtggtttacgtgttaggtatttagaagtgtccagtgtgaggtgcagctggtggagtccggggagctgggtccagcctgggggtccctgagactctcctgttcagcctctggattcacctttagtaggttttggatgagtttgggtccgccaggctccgaggggaaggggcgtggngtggtgacacagagagtagagtagagtagaagaaaatatagtagacgtacgtaggaggacgactacacactactacagagaacaacgaacaagtaattaagtagtatatagacaatagagacgacgacgagacgagacgacgacgacgacgtgtgtagttattagtgacgagag

SEQ ID NO: 336964 - DNA, 589 bp, Homo sapiens
  misc_feature: GZ8MTXP02IH04W.2.81.H04.1.454.CMB.2.raw
  modified_base (393)..(393): a, c, t, g, unknown or other
  misc_feature (393)..(393): n is a, c, g, or t
  modified_base (456)..(456): a, c, t, g, unknown or other
  misc_feature (456)..(456): n is a, c, g, or t
  modified_base (489)..(489): a, c, t, g, unknown or other
  misc_feature (489)..(489): n is a, c, g, or t
  modified_base (515)..(515): a, c, t, g, unknown or other
  misc_feature (515)..(515): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
tcagacgctcgacacacgaccggtgctcgatttagtagtgtagattcgcggggctgccctttggctttggagatggtttctcgatgggggctgggaggtctcagagaggagccttagcccctggactccaaggcctttccacttggtgatcagcactgagcacagaggactcaccatggaattggggctgagctgggttttactgttggtattttagaaggtgtccagtgtgaggtgcagctggtggaggtccggggaggcgtgggtccagccggtgggggtccctggagactctcctgttcacgcctcgtggtacttctaccttttaggtaggttttggattggtaggtttcgggtccgccgaggcctccggaaggggaggggcctaggggnggtggggtcggaccaaacgatagggagttaacggagtaggaagtagaaagaaaaactgtaggnggtactcggtaggaaggggcctattcacatccnccagacaacaacgacaagtatttagngtaatctagataaagtgagcaagcctagacgacgacgacggacncggntaagtgtattatgtcgacgaggtaaa

SEQ ID NO: 336965 - DNA, 602 bp, Homo sapiens
  misc_feature: GZ8MTXP02I9O7D.2.81.H04.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagacgctcgacacacgaccggtgctcgatttagtagtgtagattcgcgggctgccctttggctttggagatggttttctcgatgggggctgggaggtctcagagaggagccttagcccctggactccaaggcctttccacttggtgatcagcactgagcacagaggactcaccatggaattgggctgagcgtgttagtgtaggtnttagaagttgtcagtgtgaggtgcagngtggtggaggtcgggaggcgtggtcgcgcggtcgggtccgtgagctcgtctcgtcncgtcctcgtgtntctacgtttagttaggttgtagtgtggttcggtccgcgacgtcgtcgagggtaggtcgtggtaggtggtcggacgaacgagtgtagtagtagtagtagtagtaaagtaaacgtaagtagtaggtacgtacgtaggacggacgtactacgtacgtacgtacgtacgacgaacgaacgaacgaacgtaaagtaagttaagttagtacgtacgtacgtacgtaagtagagtacgacgtacgtagacgacggacggacgacgacggtacgtaagtagttagttagttagtacgtacgtagtaag

SEQ ID NO: 336966 - DNA, 613 bp, Homo sapiens
  misc_feature: GZ8MTXP02IZWWB.2.81.H04.1.454.CMB.2.raw
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtgttagtgtaggtnttagaagtgtcagtgtgagtgcagngtgtggnggtcgggnggcgtggtcgcgcggtcgggtccgtgagctctctgtcncgctctgtntctacgttagttaggtttggtagtgtggttcggtccgccgacgtcgtcggagggaggggcggtggtaggtgggtcggaccgaacgagtaggtaggtaacggtagtaggaaggtaggaaagtaaaacgtaagtaggtaggtacgtacggtaggaacgggacgtacgtacgaccactacctaccgacgaacgaacaaacgaacgtaaagtaaagtttaagttagtacgtacgtagtacgaagtagagacgacgacgtagacggacggacggacggacgacggtacgtgttagttagttagttagtacggtacgaagtaag

SEQ ID NO: 336967 - DNA, 567 bp, Homo sapiens
  misc_feature: GZ8MTXP02FWMXG.2.81.H04.1.454.CMB.2.raw
  modified_base (346)..(346): a, c, t, g, unknown or other
  misc_feature (346)..(346): n is a, c, g, or t
  modified_base (407)..(407): a, c, t, g, unknown or other
  misc_feature (407)..(407): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggttttacgtgttaggtatttagaaggttgtccagtgtgaggtgcagctggtggagtccgggggaggctggggtccagccgtgggggtccctgagctctcctgttcagcctctggattcacctttagtaggttttggatgagttgggtccncaggctcgaggagggctggagtgggtgcaacatgagtacgatggaagtagaagaaaaactntgtggactccggtagaaggggcccattcacccatcctaccagagaacaacggaacaaagaaattttaaggtattatctagaacaaatagagacgacgacgtagacgacggacggacggacgacggacgtaagttagttagttagttagtggtacgagaag

SEQ ID NO: 336968 - DNA, 557 bp, Homo sapiens
  misc_feature: GZ8MTXP02H04ZH.2.81.H04.1.454.CMB.2.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagacgctcgacacacgaccggtgctcgatttagtagtgtagattcgcgggctgccctttggctttggagatggttttctcgatgggggctgggaggtctcagagaggagccttagcccctggactccaaggcctttccacttggtgatcagcactgagcacagaggactcaccatggaattggggctgagcgtggtttacgtgtaggtatttagaagtgtcagtgtgagtgcagctgtggaggtccggggaggcgtgggtcgagccgtgggggtcccgtgagactctcctgttcagctctggatctacctttagtagtttggtatgtagttgggtcgtcagcgtccaggaaggggcgtgngtggnggacgacgagtgagtagagtagagtagaagaaatatagtagacgtacgtagaggacgtactacacactactacgagacgacgaacgaacgaagtaagttagtagtagtatagactaagtagagacgacgacgtagacgacggacggacgacgacgacgtgtagttagttagttagtacgtacgtagtaag

SEQ ID NO: 336969 - DNA, 536 bp, Homo sapiens
  misc_feature: GZ8MTXP02GJMDR.2.81.H04.1.454.CMB.2.raw
  modified_base (413)..(413): a, c, t, g, unknown or other
  misc_feature (413)..(413): n is a, c, g, or t
  modified_base (473)..(473): a, c, t, g, unknown or other
  misc_feature (473)..(473): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctggtggaggtccgggggaggctggggtccagccgtggggggtccctgagactctcctgttcagcctctggattcacctttagtaggttttggatgagttgggtccgcaggctccgagggaggggcctggagtgggtggccaacatagagtacgatggaagtgaagaaaactntgtaggactccggtgaagggccgattcaccatctccagacacaacgacaaagaatttagngtatctgcaaatgagcagcctgacgagccgaggacacggctgtgtattagtgtgacgtaggaa

SEQ ID NO: 336970 - DNA, 522 bp, Homo sapiens
  misc_feature: GZ8MTXP02GDF4Q.2.81.H04.1.454.CMB.2.raw
  modified_base (410)..(410): a, c, t, g, unknown or other
  misc_feature (410)..(410): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctggggtccaggccgtggggggtccctgagactctcctgttcagcctctggattcacctttagtaggttttggatgagttgggtccgcaggctcgagggagggctggagtgggtggccaacatgagtacgatggaagtgaagaaaactntgtgactcgtgaagggcattcacatctcagagacaacgacaagtaattagatatctgacaaatgagcacgctgagagccgaggacaggctgtgtattagtgtagcgagtaag

SEQ ID NO: 336971 - DNA, 539 bp, Homo sapiens
  misc_feature: GZ8MTXP02GUTR4.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtattttagaaggtgtccagtgtgaggtgcagctggtggagtccgggggaggctggggtccaggcctggggggtccctgagactctccctgttcagcctctggattcacctttagtaggttttggatgagttgggtccgcaggctccgaggggaaggggcctggagtgggtggccaacatgagtacgatggaagtgaagaaaactatgtggactcggtgaaaggggccgattcgaaccatctccagagacaacgacaaagaatttagagtatctgacaaatgagacagcctgagagccgacgacacggctgtgtattatgtcgacgagtaa

SEQ ID NO: 336972 - DNA, 672 bp, Homo sapiens
  misc_feature: GZ8MTXP02IQOUF.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttactgttaggtatttagaaggtgtcagtgtgaggtgcagctggtggaggtccgggggagcgtggggtccagccgtgggggtccctgagctctcctgttcagcctctggattctacctttagtaggttttgatgagttggtccgcaggctcgagggaggctggagtggtgcaacgatagagtacgataggaagtgaaagtaaaactgtagtaggactccggtaggaaacggggcccgtaagtttacccgaacctacgtacctacccgaaaggtaacggaaaccaaaaccggaaactaaaaggtaaagtttttaacgtaggttaaacctttcgtaggaacctaaaagttcggaaggtaccaacggccccgttagggaaccgaacggggaccccggaaggggaaacccgttaaccggggccttaaggtttacggttaactttaacggtttcggttacggtacggtaaaggtaaacg

SEQ ID NO: 336973 - DNA, 613 bp, Homo sapiens
  misc_feature: GZ8MTXP02FTM60.2.81.H04.1.454.CMB.2.raw
  modified_base (234)..(235): a, c, t, g, unknown or other
  misc_feature (234)..(235): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttacgtgtaggtcttagaagtgtcagtgtgaggtgnngngtggtggaggtcggggnggcgtggtcgcgcggtcggggtccgtgagctctctcgtcncgcctcgtgtnttctacgtttagttaggtttggtagtggtaggtcgggtccgccgacggcgtcggagggagggcggtagggtaggtgggtcggacgaacgaagtagtacgtacgtagtaggaagtaagaaagtaaaacgtaagtagtacggtacgtacgtaggaacggacgtacgtacgactactaccgtacgacgaacgaacgaacgaaacgtaaagtaagttaagttagtagtacgtagtacgtaagtagagacgacgacgagacgacgacggacggacgacgtacgtgtagttagttacgttgtacgacgagtaag

SEQ ID NO: 336974 - DNA, 553 bp, Homo sapiens
  misc_feature: GZ8MTXP02JZF3D.2.81.H04.1.454.CMB.2.raw
  modified_base (416)..(416): a, c, t, g, unknown or other
  misc_feature (416)..(416): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgaggtgcagctgggtggaggtccggggaggctggggtccaggccgtggggggtccctgagactctcctgttcagcctctggattcacctttagtaggtttggatgagttgggtccgcaggctccgaggggaaggggcctgggagtgggtggccaacatgagtacgatgggaagtgaagaaaactntgtggactccgtggagggccgattcaccatctcagagaccaacgacaaagtaatttagtgtatctagacaaagtgaagcaacgccgtagacggacgaccgaggaccgacggctgtgtatttagtgtgacggagtaag

SEQ ID NO: 336975 - DNA, 541 bp, Homo sapiens
  misc_feature: GZ8MTXP02HU4GZ.2.81.H04.1.454.CMB.2.raw
  modified_base (417)..(417): a, c, t, g, unknown or other
  misc_feature (417)..(417): n is a, c, g, or t
  modified_base (452)..(452): a, c, t, g, unknown or other
  misc_feature (452)..(452): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggaggtccgggggaggctggggtccaggcccgtggggggtccctggagactctcctgttcagcctctggattcacctttagtaggttttggatggagttgggtccgcaggctccgagggaggggcctggagtgggtggccaacatgagtacgatggaagtgaaagaaaactntagtggactccggtagaaggggccgattcacatcnccagagacaacgaacaagtaattagtgtatctagacaaatgagcagcctgacgagccgagacgacgctgtgtattagtgtgcgtagaag

SEQ ID NO: 336976 - DNA, 554 bp, Homo sapiens
  misc_feature: GZ8MTXP02GDN82.2.81.H04.1.454.CMB.2.raw
  modified_base (345)..(345): a, c, t, g, unknown or other
  misc_feature (345)..(345): n is a, c, g, or t
  modified_base (386)..(386): a, c, t, g, unknown or other
  misc_feature (386)..(386): n is a, c, g, or t
  modified_base (520)..(520): a, c, t, g, unknown or other
  misc_feature (520)..(520): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtgggttttacttgttggtatttagaaggtgtccagtgtgaggtgcagctggtggagtccgggggagctggggtccagccgtgggggtccctgagactctcctgttcagcctctggattcacctttagtaggttttggatgagttgggtccnccaggctccgaggggaggggcctgggagtgggtggccaacntagagtacgatggaagtgaaagaaaactgtggtggactccggtggaaaggggcccgaagtttccacccatctccaagacgacaacgaacaaggtaatttagtgtaatctagacaaagtgagcacgcctgaacgngccgagacacggctgtgtattagtgtgcgagaag

SEQ ID NO: 336977 - DNA, 577 bp, Homo sapiens
  misc_feature: GZ8MTXP02HNKUX.2.81.H04.1.454.CMB.2.raw
  modified_base (222)..(222): a, c, t, g, unknown or other
  misc_feature (222)..(222): n is a, c, g, or t
  modified_base (315)..(315): a, c, t, g, unknown or other
  misc_feature (315)..(315): n is a, c, g, or t
  modified_base (436)..(436): a, c, t, g, unknown or other
  misc_feature (436)..(436): n is a, c, g, or t
  modified_base (504)..(504): a, c, t, g, unknown or other
  misc_feature (504)..(504): n is a, c, g, or t
  modified_base (550)..(550): a, c, t, g, unknown or other
  misc_feature (550)..(550): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtntcagtgtgaggtgcagctgggtggaggtccggggggaggcgtggggtccaggccgtggggggtccctggagactctcctgttcagcctctggnttctacctttagtaggttttggatggtaggttgggtcccgccgaggctccgaggggaggggccgtgggaggtggggtggccaacagtaggagtacgagtagggaagtaggaaagaaaactntggtaggactcggtaggaacggggcctattcaccatcctaccagacgacaaacgacaagtaatttagngtatctgacaaatgagcacgcgtagacgcgacgacggacaccggtntgtagtattagtggtagacgaagtaag

SEQ ID NO: 336978 - DNA, 577 bp, Homo sapiens
  misc_feature: GZ8MTXP02IG7HN.2.81.H04.1.454.CMB.2.raw
  modified_base (508)..(508): a, c, t, g, unknown or other
  misc_feature (508)..(508): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctgggttttacttgttggtatttagaaggtgtccagtgtgaggtgcagctggtggagtccggggaggctggggtccaggccgtgggggtccctggagactctcctgttcagcctctggattcacctttagtaggtttggatgagtttgggtccgccgaggctccgaggggaaggggcctggagtgggtggccaacatagagtacgagtggaagtgaaagaaaaactataggtaggactccgtaggaaacgggccgtaagtttccaaccgtatacctacccgaagaacgaaccaaacgaaacaaagtaatttaagngtaatctgactaaatgagacagcctagacgagccgagacacggctaagtgtattatgtcgacgtagaag

SEQ ID NO: 336979 - DNA, 553 bp, Homo sapiens
  misc_feature: GZ8MTXP02FRVOE.2.81.H04.1.454.CMB.2.raw
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
  modified_base (494)..(494): a, c, t, g, unknown or other
  misc_feature (494)..(494): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagagtgtccagtgtgaggtgcagctggtggaggtccgggggagctggggtccagccgtggggggtccctgagactctcctgttcagcctntggattcacctttagtaggttttggatggagttgggtccgccgaggctccgaggggagggcctggagtgggtggccaacagtgagtacgagtagggaagtgaaagaaaactntaggtggactccggtaggaaacggggcccagttccaaccgatcctaccaggaacgacaaacgactaaagtaatttagngtatctgacaaatgagcagctagacgagccgagacncggntgtntatatgngcgagtag

SEQ ID NO: 336980 - DNA, 556 bp, Homo sapiens
  misc_feature: GZ8MTXP02HO2NS.2.81.H04.1.454.CMB.2.raw
  modified_base (471)..(471): a, c, t, g, unknown or other
  misc_feature (471)..(471): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccggggaggctggggtccagccgtgggggtccctggagactctcctgttcagcctctggattcacctttagtaggtttggatgagtttgggtccgcaggctccgagggaaggggcctggagtgggtggccaacgatagagtaacgatggaaagtgaaagaaaaactagtgaggactccgtagaaagggccgaattcaccatcctacagagacaaacgaanaaagtaagttagtagtatcagacaatagagacacgacgagacgacgacgacgacgacgacgtgtagtattattagtgacgagaag

SEQ ID NO: 336981 - DNA, 608 bp, Homo sapiens
  misc_feature: GZ8MTXP02IWNGD.2.81.H04.1.454.CMB.2.raw
  modified_base (305)..(305): a, c, t, g, unknown or other
  misc_feature (305)..(305): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagcgtggtttactgttggtatttagaaggtgtccagtgtgaggtgcagctggtggaggtccgggggagcgtgggtccaggccgtgggggtccctgagctctcctgttcagcctntggattctactttaggtaggttttggattggaggtttcgggtcccgcgaggccgtccggaggggaaggggcccgtgggaggtggggtcggccctaaagagtagagtacgagtagggaagtagaaagaaaaaacgttgtaggtacggactcggtaggaaacgggggtccctattaccaacctatcctaccaaggaacgaaccaaacgtaacaaagtaatttagtagtatctagacaaatgaagcgaacgtccaggaacgacgaccggagaccgaggtgtgtagtattgtgtcggagtaagtaag

SEQ ID NO: 336982 - DNA, 638 bp, Homo sapiens
  misc_feature: GZ8MTXP02HPIEN.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgaggtgcagctggtggaggtccgggggagcgtgggtccagccgtgggggtccctggagactctcctgttcagcctctggattctacccttttagtaggttttggatggtaggtttgggtccgccgaggctccgaggggaaggggcctgggagtggggtggaccaacgagtagagtacgatgggaagtggaaagaaaaactagtagtacggtacctccggtaggaaaggggacccgtaagttccaacctattcctacccgaaggaacgaaccgaaaacgaacaaagtaaagttttaagtagttaactcgttagacaaaatcggaagaccgagacccgtggaacgacggtcccggaaaggccgaacggccttggtagttaacgtttacgtggtaggacggtaggtaaag

SEQ ID NO: 336983 - DNA, 588 bp, Homo sapiens
  misc_feature: GZ8MTXP02I4JT6.2.81.H04.1.454.CMB.2.raw
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (383)..(383): a, c, t, g, unknown or other
  misc_feature (383)..(383): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagccggtgtttacgtgtaggtcgtttagaagtgtcagtgtgagtgcngngtggtggnggcgggnggcgtggtcgcgtcggtcgggtccgtcgagctctcgtcgtcgcgtcctcgtgtattactacgtttagttaggttgtgtgtggtcggtccgcgcgcgcggagggaggtcgtggtggtggtcgacgagagngagagagtagagagaaagtaaatagtagtagacgtacgacggacgacgtactacactactacacgaacgaacgaacgaacgaaacgtaaagttaagttaagttacgtacgtacgtacgtaacgtaagtagacgacgacgacgagacggacggacggacgacgtacgtacgtaagtagttagttagttagtacgtacgtaagtaag

SEQ ID NO: 336984 - DNA, 675 bp, Homo sapiens
  misc_feature: GZ8MTXP02H78F2.2.81.H04.1.454.CMB.2.raw
  modified_base (163)..(163): a, c, t, g, unknown or other
  misc_feature (163)..(163): n is a, c, g, or t
  modified_base (224)..(224): a, c, t, g, unknown or other
  misc_feature (224)..(224): n is a, c, g, or t
  modified_base (387)..(387): a, c, t, g, unknown or other
  misc_feature (387)..(387): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcanagaggactcaccatggaattggggctgagctgggttttacttgttggtattttagaaggtntcagtgtgagtgcagctgggtggaggtccgggggagcgtggggtccaggcccggtgggggtccctggacgactctcctgttcagcctcgtggattctacctttagtaggtttggatggaggtttgggtccgcgaggcgtcgaggggagggccgtggagtgggngacaacgagtagagtacgagtagggaagtagaaagtaaaaactgtaggaggtactaccggtaggaacgggaccgtaagttaccaacctacgtacctaccgaaaggaacgaaaccgaaaacggtaaactaaaagtaacgttttaaggtagttaattaccgtagaaactaaaagtgaaaacggcctaaggacccgttagggaaacacgggacccggaaaacgggacgtaacccgggtacgttggttaagtaacgttttacgttccggtacggaacggttaaaggtaaaag

SEQ ID NO: 336985 - DNA, 604 bp, Homo sapiens
  misc_feature: GZ8MTXP02HOWAH.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggaggtccgggggaggctgggtccagccgtggggggtccctgagactctcctgttcagcctctggattcacctttagtaggttttggatgagtttgggtccgcaggctccgaggggaggggccgtgggagtggggtggaccaaacagtaggagttaacgagtagggaaagtaggaaagaaaaaactagtggtaggactcccggtaggaaacgggggcccgtagttaccaaccctatccgtacccaaggacgaacaaaaccggaacaaaggtaatttaagtgttaatcctagacaaatgaagccgagcctaggacgacgaccggagaccacggctgtgtatttagttgtgacgagtaag

SEQ ID NO: 336986 - DNA, 551 bp, Homo sapiens
  misc_feature: GZ8MTXP02FFGJJ.2.81.H04.1.454.CMB.2.raw
  modified_base (451)..(451): a, c, t, g, unknown or other
  misc_feature (451)..(451): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagaagtgtccagtgtgaggtgcagctggtggagtccgggggaggctggggtcccaggcctggggggtccctgagactctcctgttcagcctctggattcacctttagtaggttttggatgagttgggtccgccaggctcgagggaggggcctgggagtggggtggccaacatagagtaacgatagggaagtgaagaaaaactagtagtggactccgtagaacgggccgattcacctntacctccagagaacaacgacaaagtaatttagtagtatctagacaaatgagacagcctgacgagccgaggacacggctgtagtatattggcgacgagaag

SEQ ID NO: 336987 - DNA, 660 bp, Homo sapiens
  misc_feature: GZ8MTXP02J2CFK.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtattttagaaggtgtccagtgtgaggtgcagctgggtggaggtccggggaggcgtggggtcccaggccgtggggggtccctgagactctcctgttcacgcctcgtggacttctacctttaggtaggtttggatggtaggtttcgggtccgccgaggctaccgaggggaaggggccgtgggaggtggggtggaccaacgagtaggagtacgagtagggaagtagaaagaaaactgtacggtaggactccgggtaggaaacggggccgtaattaccaaccgtacttccgaccgaaggaacgaaacaaacgaacaaagtaatttaggtataacttactagactaaaagtggaaacgcacgcccgtaggaacggaacggaccggaaggtaaccgaccgggtcgttaaggttacggtttaagttacggtttggacggtaaccggtaaggtaaaacg

SEQ ID NO: 336988 - DNA, 692 bp, Homo sapiens
  misc_feature: GZ8MTXP02HPMAS.2.81.H04.1.454.CMB.2.raw
  modified_base (347)..(347): a, c, t, g, unknown or other
  misc_feature (347)..(347): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttactgtaggtatttagaaggtgtcagtgtgaggtgcagctggtggaggtccggggagcgtgggtccaggcccgtgggggtccctgacgctctcctgttcagctcgtggacttctacctttagtaggtttggattgaggtttgggtccncgaggtcctccgaggggaagggccgtggaggtgggtcggaccgaacgagtagtagtacgagtaggaagtagaaagtaaaagtagtagtaggtacgtaccggtaggaaagggaccggtacttacaaccacgtactccgaagaacgaaacgtaaacgaaccgtaaagtaacgtttagttaaccggaattcccggtaaacgtaaacgtaacgtaacgtaacgtaacgtaccgtacggtaacggaacggaaccgggaaccgggaaccgggaaccggtaaccggtacggttaacggtttaacggtttaacggtttacggttacggttacggtaacggtaaacggtaaacg

SEQ ID NO: 336989 - DNA, 542 bp, Homo sapiens
  misc_feature: GZ8MTXP02FVLRH.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttactgttggtatttagaaggtgtccagtgtgaggtgcagctggtggaggtccggggaggctgggtccagcctggggggtccctgagactctcctgttcagcctctggattcacctttagtaggttttggatgagttgggtccgcgaggctcgaggggaggggcctgggagtggggtggccaaacgataggagtacgagtagggaagtagaagaaaaactatgtaggactcgtgaaagggccgattcaccatctccagacgacaaacgacaaagaatttagagtatcagacaaatgagcacgctgagagcgagacacggctgtgtaattatggtagcgagtaag

SEQ ID NO: 336990 - DNA, 537 bp, Homo sapiens
  misc_feature: GZ8MTXP02GDWUY.2.81.H04.1.454.CMB.2.raw
  modified_base (461)..(461): a, c, t, g, unknown or other
  misc_feature (461)..(461): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagaggtgtccagtgtgaggtgcagctggtggagtccggggagctgggtccagccgtgggggtccctgagactctcctgttcagcctctggattcactttagtaggtttgatgagttgggtccgcaggctccgagggaggggcctgggagtgggtggccaagatgagtacgatggaagtgaagaaaactgtgtggactccggaggaagggccattcaccatcctcagagacaacgacaagtacttagngtaatctagacaaatgagcagctagagcgaccgaggacacgggtactggttagtagtttagtgtacgcgaagtaag

SEQ ID NO: 336991 - DNA, 548 bp, Homo sapiens
  misc_feature: GZ8MTXP02GXENG.2.81.H04.1.454.CMB.2.raw
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagacgctcgacacacgaccggtgctcgatttagtagtgtagattcgcgggctgccctttggctttggagatggttttctcgatgggggctgggaggtctcagagaggagccttagccctggactccaaggcctttccacttggtgatcagcactgagcacagaggactcaccatggaattggggctgagcgtggtttacgtgttaggtatttagaagtgtcagtgtgagtgcagctggtggagtccggggagctgggtccaggcctgggggtccccngagctctctgtcacgcctntgtatctacgtttagtaggtttgatgtagttcggccgcgagctcgaggggaggcgtggnggtggtgacgacagngagagagtagagtagaagaaatatagtgtacgtacgtaggaggacgactacacactactacgagaacgaacgaacgaacgtaaagtaagttagtagtatatagacgaatagagacgacgacgagacgacgacggacgacgacgacgtgtgttagttagttagtacgacgaagtaag

SEQ ID NO: 336992 - DNA, 708 bp, Homo sapiens
  misc_feature: GZ8MTXP02H3H7J.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaggtgtcagtgtgagtgcagctggtggagtccgggggagcgtggggtccaggccgtggggggtccctggagactctcctgttcagcctctggattctaccgttttagtaggttttggattggtagtttgggtccgccgaggcctaccggaggggaaggggccgtggggaggtggggtcggaccaaacgagtaggaaggttaacgagttaggggaaagttaggaaagtaaaaaacgtgtaggtagggaaccttcccgggtaggaaaacgggggtccccgtaaagtttcccgaaacccgtaacttccctaacccgaaggaaacgaaaccaaaacggaaaccaaaaggtaaattttaggtagttaaactcgttagaactaaaagttgaaacgaccaaggtacccgttaggaaacgaacggaccccggaaagggaaccgaaccggggccttaaggttacgttaagtttacgttggtaggaaccggtaaggaaag

SEQ ID NO: 336993 - DNA, 574 bp, Homo sapiens
  misc_feature: GZ8MTXP02FNQK0.2.81.H04.1.454.CMB.2.raw
  modified_base (341)..(341): a, c, t, g, unknown or other
  misc_feature (341)..(341): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagaggtgtccagtgtgagtgcagctggtggaggtccgggggagcgtggggtccaggccgtggggggtccctgagctctcctgtcagcctctggattcactttagtaggttttggatgagttgggccncgaggctcgagggagggctggagtgggtgcaacatgagtacgagtaggaagtagaaagaaaaactagtggtacggactccggtaggaaacggggcccgaattaccgaccctatcctaccgaagaacgaaccaacggaacaaagtaatttagtagtatctagacaaagtgaacgcaagcctagacgacgacccggaggaccgacggctggtagttattagttgtgacgtagaag

SEQ ID NO: 336994 - DNA, 562 bp, Homo sapiens
  misc_feature: GZ8MTXP02IQDZV.2.81.H04.1.454.CMB.2.raw
  modified_base (487)..(487): a, c, t, g, unknown or other
  misc_feature (487)..(487): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctgggtggagtccgggggaggctggggtccaggccgtggggggtccctgagactctcctgttcagcctctggattctacctttagtaggttttggatgaggttgggtcgccgaggctccgaggggaggggcctggagtgggtggcaacatagagtacgagtggaagtgaaagaaaactagtgtaggactccggtaggaacgggacgattcaccatactcagagaacaacgaacaagtaatttaagngtaatctgacaaagtgaagcagccgtgacgaggccgagaccgacggctaagtgtattagttgtgtcggagtaaag

SEQ ID NO: 336995 - DNA, 621 bp, Homo sapiens
  misc_feature: GZ8MTXP02GBCXY.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgaggtgcagctggtggaggtccggggaggcgtgggtccaggccgtgggggtccctgagactctcctgttcagcctctggtattctacctttaggttaggttttggattggtaggtttcggggtcccgccgacgggccgtccggagggggaagggggccgtggggaggtggggtcggaccgaaacgagtaggagtacggagtaggaagtagaaagaaaactagtgtaggacctcggaggaacgggccgattccacctatctaccgagacgaacaacgaacgaaagtaagtttagtagtaatctagactaaagtgagcgaacgcctaggacggacgcccggaaggacgaccggtgtggttagttaagtttacgttggtagacggtaagtaaag

SEQ ID NO: 336996 - DNA, 567 bp, Homo sapiens
  misc_feature: GZ8MTXP02IUK0U.2.81.H04.1.454.CMB.2.raw
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
  modified_base (505)..(505): a, c, t, g, unknown or other
  misc_feature (505)..(505): n is a, c, g, or t
  modified_base (536)..(536): a, c, t, g, unknown or other
  misc_feature (536)..(536): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtatttagaaggtgtccagtgtgaggtgcagctggtggaggtccggggagcgtgggtccagccgtggggtccctgagctctctgtcgctctggnttcactttagtggtttgatgtagttcggtcccgcgaggcctccgaggggaacggggctgggagtgggtcgaccaacagtagngtacgagtaggaagtagaaagtaaaactgtagtggactccggtaggaacggccgtattccactagtcctacagaacgaacaacgaacaaagtaatttagagtatcgtagacaaatgaancgaagtcctagagcgaccgaggacgacggtntagtaagtacttagtgtagagtagaagtaaa

SEQ ID NO: 336997 - DNA, 585 bp, Homo sapiens
  misc_feature: GZ8MTXP02JU242.2.81.H04.1.454.CMB.2.raw
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (527)..(527): a, c, t, g, unknown or other
  misc_feature (527)..(527): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctgggtggaggtccgggggaggctgggtcccaggccgtggggggtccctgagactctcctgttcagcctctggattcacctttaggtaggttttggattggagtttgggtccgccgaggctccgaggggaaggggcctgggagtggggtggccaacgatgagtacgagtggaagtgaaagaaaactagtggtagacgtcccggtaggaaggggcccgtattccgaccagtcctacccgagacgaacaacgacaaagtaatttagngtaatntagactaaagtgaancgagcctaggacgacgccggaggaccgacggntggtnttaattgtgtagcgaagtaag

SEQ ID NO: 336998 - DNA, 797 bp, Homo sapiens
  misc_feature: GZ8MTXP02FZD89.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaggtgtcagtgtgaggtgcagcgtggtggaggtccggggaggcgtggggtccaggccgtgggggtccctggagactctcctgttcagtcctctggtacttctaccgtttagttaggttttggattggtaggtttcgggtcccgtccgacggtccgtccggaagggggaacggggtcccgtaggggtaggtggggtacggacccgaaacgtaagttagggacgttaaacggtaagttaggggaaagggttaaggaaaacggtaaaaaaacgtttgtagggttaacgggtaaccgttacccggggtaagggaaaccgggggtaccccgtaacgtttaccccgaaacccgtaacgttaccccgtaacccgaaaaggtaaccgaaacccaaaaccggtaaaccgtaaaaggttaaaacgttttaaggtacgttaaattaccgtaaggtaacctaaaaagttcggaaacgaccgtaacggtacccgttaaggaaacggaacggaccccgggaaagggaacccgtacggggtaaccgttgggtttacgttaaagttttacgttaggttaggaacggtaagtaaaagg

SEQ ID NO: 336999 - DNA, 631 bp, Homo sapiens
  misc_feature: GZ8MTXP02INSD5.2.81.H04.1.454.CMB.2.raw
  modified_base (230)..(231): a, c, t, g, unknown or other
  misc_feature (230)..(231): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (361)..(361): a, c, t, g, unknown or other
  misc_feature (361)..(361): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattgggctgagcggtgttagtcgtaggtcttagaagtgcagtgtgagtgnngngnggtggnggtcggnggngtggcgcgcggtcgggtcgngcgctctcgtcgtcgcgtctcgtgtacttcttacgtttagttaggtttggtagtgtggttcgggtccgcgcggcgacggagggagggcgnggtaggtgggtacggacgaacgaagtaggtaagtacgtagtaggtaagtaagtaaagtaaaacgtaagtaggtaggtacgtacggtacggaacgggacgtactactaaccgtactacgtaccgaacgaacgaaacgaaacgtaaacgtaaagttaacgttaagttagtactacgtacgtaacgtaaagtagagacgacgtacgacgacgacggacggacgaacgacgtacgtaagttagttacgttagtagtacggtacgtaacgtaaag

SEQ ID NO: 337000 - DNA, 594 bp, Homo sapiens
  misc_feature: GZ8MTXP02FSGD8.2.81.H04.1.454.CMB.2.raw
  modified_base (502)..(502): a, c, t, g, unknown or other
  misc_feature (502)..(502): n is a, c, g, or t
  modified_base (558)..(558): a, c, t, g, unknown or other
  misc_feature (558)..(558): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgaggtgcagctgggtggaggtccgggggaggcgtgggtccaggccgtggggggtccctgagactctcctgttcagcctctggattctacctttagtaggttttggatggagtttgggtccgcgaggctccgaggggaaggggccgtgggaggtggggtcggaccaaacgagtaggagtacgagtagggaagtagaaagaaaactgtagtaggactccggtaggaacggggccgattccgaacctatcctaccaaggacgaacaaaccgaanaaagtaatttagagtatctagacaaagtgagcaagcctagacgagaccgaggaccncggtactggtattaattagtgtacgacgaagtaaag

SEQ ID NO: 337001 - DNA, 697 bp, Homo sapiens
  misc_feature: GZ8MTXP02HCVYK.2.81.H04.1.454.CMB.2.raw
  modified_base (373)..(373): a, c, t, g, unknown or other
  misc_feature (373)..(373): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgagtgcagctggtggaggtccgggggagctgggtccagccgtgggggtccctgagactctcctgtcagcctctggattctacctttagtaggttttggatggagttgggtccgcaggctccgagggaggccgtggagtgggngcaacatagagtacgatagggaagtagaagaaaaactgtaggtaggtacctccggtagggaaaacgggggtcccgtaatttacccgaaacccgtacgttaccccgttaaccccgaaagggaaccggaaacccaaaacccggggtaaaccgtaaaaacggtaaaacgtttttaaacgttaggttaaacttaccgttaggaaccctaaaaagttaccggaagtaacccgacggacccttgggaaacggtacggaccccggaaagggaacccgtaacgggccgttgttaggttaacgtttaacgtcggttaggacggaagtaaaagg

SEQ ID NO: 337002 - DNA, 672 bp, Homo sapiens
  misc_feature: GZ8MTXP02H3MIG.2.81.H04.1.454.CMB.2.raw
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttcacttggtgatcagcactgagcacagaggactcaccatggaattggggctgagctgggttttacttgttggtattttagaggtgtcagtgtgaggtgcagcgtggtggaggtccgggggaggcgtggggtccaggccgtgggggtccctggagactctcctgtcagcctngnttctactttagtaggtttgatgtagttgggtccgcgaggctcggagggagggcgtggaggtgggcgcaanatgagtacgagtagaagtagaaanaaaactgaggtcggacgtcggaggacgggcctagttccaacgtactccgtacgaaggtaacgaaccgaaaacgtaacgtaaaagttaagttttaacggtagttaacgttacttacggaactaaaagttcggaaacgtccgtacggacccgtttaaggaaacggaaccggggacccggaaacggggtaccccgtaacgggggtacctttaacgggttacgtttaaaacgttttacggttaggtacggtaccggtaaaaggttaaaacgg

SEQ ID NO: 337003 - DNA, 615 bp, Homo sapiens
  misc_feature: GZ8MTXP02JFEHM.2.81.H04.1.454.CMB.2.raw
  modified_base (526)..(526): a, c, t, g, unknown or other
  misc_feature (526)..(526): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctgggtggaggtccggggggaggcgtggggtcccaggcccgtgggggggtcccctggagactctcctgttcagcctctggattcactttagtaggtttgatgagttgggtccgcaggctccgaggggaacggggcctgggacggtggggtcggccaacgataggagtacggatagggaagttggaaagaaaaactgtagtaggactccggtaggaacggggtcccgattaccgaaccctatccgtacccaaggacgaaaccaaacgacaaaaggtattttaaggntactcttagacaaaagtgaagccgaagcccgtaggacgaggcccggaggaaccgcggatggtagttaattagttggtagacgagtaaag

SEQ ID NO: 337004 - DNA, 642 bp, Homo sapiens
  misc_feature: GZ8MTXP02JRQ2Z.2.81.H04.1.454.CMB.2.raw
  modified_base (384)..(384): a, c, t, g, unknown or other
  misc_feature (384)..(384): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaagttggggctgagctgggttttactgttggtatttagaaggtgtccagtgtgaggtgcagcgtggtggaggtccggggagcgtggtcaggccgtgggggtccctgagctctcctgtcagcctgtggtattctaccgtttaggtaggttttggagtggtaggttcgggtccgcgtcggctaccggaggggagggcccgtaggggnggtcggacgacagagtagagtagtagtagaagtaagaaagtaaacgtagtacggtacggtaccgtacggtaggaaccggtaccgtacgtaccgaaccgtacgtaccgtacgaacgaacgaaacgtaacgaaactaaagttaagttagtacgtacgtacgtacgtacgtaagtacgacgacgtacgtacgtacggacggacggacggacgacggacgtacgtaagtagttacgttacgttaggtacggtacgtagtaag

SEQ ID NO: 337005 - DNA, 560 bp, Homo sapiens
  misc_feature: GZ8MTXP02IYCOZ.2.81.H04.1.454.CMB.2.raw
  modified_base (221)..(221): a, c, t, g, unknown or other
  misc_feature (221)..(221): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagaggtntccagtgtgaggtgcagctggtggagtccggggagctgggtccagccgtgggggtccctgagactctcctgttcagcctctggattctacctttagtaggttttggattggagtttgggtccgccaggctccgaggggaggggcctgggagtggggtggccaacgataggagtacgagtagggaagtagaaagaaaaactagtggtaggactccggtagaacggggtccgattcaccatacctccagacgaaccaaacgacaaagaatttagagtatctgacaaatcgagtcagctagacgagcgaggacacggctgtgttattagtgtacgagagtag

SEQ ID NO: 337006 - DNA, 585 bp, Homo sapiens
  misc_feature: GZ8MTXP02JI697.2.81.H04.1.454.CMB.2.raw
  modified_base (393)..(393): a, c, t, g, unknown or other
  misc_feature (393)..(393): n is a, c, g, or t
  modified_base (554)..(554): a, c, t, g, unknown or other
  misc_feature (554)..(554): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttactgttggtatttagaggtgtccagtgtgaggtgcagctggtggaggtccgggggaggcgtggggtccaggccgtgggggtccctgagactctcctgttcagcctctggattcctacctttaggtaggtttggattgtaggttgggtccgcgaggcctccgaggggagggccgtgggaggtggggtgccaaanatagagtacgagtaggaagtagaaagaaaactgtgtaggactcggtaggaaacgggtcattccgaacctagtcctaccgaagacgaacaaacgacaaagtaagtttagagtatacgtgaactaaagtgagcgtacgctagacgacgacgacggtacgacgngtaagtagttactagttgacgacgagtaaag

SEQ ID NO: 337007 - DNA, 558 bp, Homo sapiens
  misc_feature: GZ8MTXP02I0JON.2.81.H04.1.454.CMB.2.raw
  modified_base (222)..(222): a, c, t, g, unknown or other
  misc_feature (222)..(222): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
tcagacgctcgacacacgaccggtgctcgatttagtagtgtagattcgcggggctgccctttggctttggagatggttttctcgatgggggctgggaggtctcagagaggagccttagccctggacctccaaggcctttccacttggtgatcagcactgagcacagaggactcaccatggaattggggctgagctgggtttacttgttggtatttagaggtntcagtgtgaggtgcagctggtggaggtccggggagcgtgggtcagcgtgggggccctgagactctcctgttcagcctctggattctacctttagtaggttttggatgtagttgggtccgccaggctccgaggggagggctgggagtgggtcgccaacatagagtacgagtaggaagtgaaagaaaactgtggtggactcggtgaaggggcattcacatcncagacacaacganaagtattagngtatctgacaaatgagcaacgcctaggacgacggaccggaaggaccgacggtactggtagttaagtttagttggtacggacggtaagtaaaag

SEQ ID NO: 337008 - DNA, 640 bp, Homo sapiens
  misc_feature: GZ8MTXP02HKISO.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtatttagaaggtgtcagtgtgaggtgcagcgtggtggaggtccgggggagcgtggggtccaggccggtgggggtccctggacgcctctcctgtcacgcctcgtggattcctaccttttaggtaggttttggagtggtaggttcgggtccgcgaggcctaccggaaggggaaggggccgtggggaggtggggtacggaccaaacgagtagagtacgagtagggaagtagaaaagtaaaaactagtggtacggaccgtccgggtaggaaccgggcgtaacgttaccaacctattccacgaagaacgaacaaacgaacgaaagtaagtttagtagtatacgtagaactaaagtgacgacgacgaccgtagaacgacggacccggaaggacgacggtctaaggtagttaagttagtgtacggacgtaagaaag

SEQ ID NO: 337009 - DNA, 684 bp, Homo sapiens
  misc_feature: GZ8MTXP02ILVR8.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctgggtggaggtccgggggaggcgtgggtccagccggtgggggtccctggagctctcctgttcacgtcctcgtggtacttctaccgttttaggttaggttttggagttggtaggtttcggggtccgccgacgggtccgtaccggaggggtaacggggcccgtaggggagggtcggggtacggacccaaacgtaagtaggaggtaacggaaggtaggaaaggtaggaaaagtaaaaactgtggtaggtaccgtccgggtaggaaacggggcctaacgttacaacccgtactcctaccgaagaacggtaaacccaaacggaaactaaaaggttaatttaagtacgttatacgttagaaactaaagtagacgacaacggtctaggacgacggacggacggaaccgcggtctaaggttagttattacgtagtcgacggtaagtaaag

SEQ ID NO: 337010 - DNA, 591 bp, Homo sapiens
  misc_feature: GZ8MTXP02JKINV.2.81.H04.1.454.CMB.2.raw
  modified_base (336)..(336): a, c, t, g, unknown or other
  misc_feature (336)..(336): n is a, c, g, or t
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
  modified_base (591)..(591): a, c, t, g, unknown or other
  misc_feature (591)..(591): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttactgtaggtatttagaagtgtcagtgtgagtgcagctggtggaggtccggggagcgtgggtccagccgtgggggtccctgagactctcctgttcagcctctgattcacctttagtaggtttgatgagttgggtccncaggctccgaggggagggcctggagtgggtcggccaanatagagtagagtaggaagtagaagaaaaatntagtaggaactccggtaggaaagggggccctatttaccaacccaattcccacccgaaagggacgaaaactaaaacccgggaactaaaagggttaaactttttaaggggtacgttaaaattcccgggttaaaacgtaaacgtaaacgtaacgtaacggtaacgtacggtaccggtacggaaacgggn

SEQ ID NO: 337011 - DNA, 823 bp, Homo sapiens
  misc_feature: GZ8MTXP02JBN24.2.81.H04.1.454.CMB.2.raw
  modified_base (304)..(304): a, c, t, g, unknown or other
  misc_feature (304)..(304): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttgtatttagaggtgtccagtgtgaggtgcagcgtgggtggaggtccgggggaggcgtggggtccaggccggtgggggtccctgacgctctcctgtcncgtcctctggtacttctaccgtttaggttaggttttggagttggtaggtttcggggtcccgccgacggtccgtaccggaagggggtacggggtccgtaggggagggtggggtacggacccgaaacgtagtagggtacgtaacggagttaggggaaagttaggaaaacggtaaaaaacgttagttacgggttacgggtaaccgttacccggggttaagggaaaccgggggtacccgttaacgtttacccgaaaccccttaacgttaccccgtaaccgaaacggaaaccgaaaaccgaaaaacccggtaaaccgtaaaaacggtttaaaacgttttaaacggtaggttaaacttaccggttaaggtaaacctaaaaagttcggaaacggtacccgtaacggaccccgttagggaaaccgggtaaaccggaccccgggaaaggggaaacccgaccgggttacgttaagggttacgtttaaaggttttaggttacggtacggtaacgggaaaggtttaaaagg

SEQ ID NO: 337012 - DNA, 679 bp, Homo sapiens
  misc_feature: GZ8MTXP02G0965.2.81.H04.1.454.CMB.2.raw
  modified_base (299)..(299): a, c, t, g, unknown or other
  misc_feature (299)..(299): n is a, c, g, or t
  modified_base (667)..(667): a, c, t, g, unknown or other
  misc_feature (667)..(667): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttacttgttgtatttagagtgtccagtgtgaggtgcagctggtggaggtccggggagcgtgggtcaggccgtgggggtccctgagctctcctgttcagcctntggattctaccgttttagtaggttttggattggtaggtttcgggtcccgaccgacggtccgttaccggaagggggaacggggtccccgtaggggaggttcgggggtacggtacccgaaacgtaagtacggaacgtaacggtagtaggggtaaagtaggaaaagtaaaaaaccgttgttaggtacggtaacccgttccgggtaagggaaaccggggtccgtaacgttacccaaccgtactccgtacccgaaaggacgaaccgaaacgaactaaaggttaactttaggagttactacgttagaactaaagtgaagcgaacgtccgtaggaacggacgaccggaaggaccacggtctgttagtaattgtgngacgaagtaaag

SEQ ID NO: 337013 - DNA, 588 bp, Homo sapiens
  misc_feature: GZ8MTXP02JGZ9J.2.81.H04.1.454.CMB.2.raw
  modified_base (381)..(381): a, c, t, g, unknown or other
  misc_feature (381)..(381): n is a, c, g, or t
  modified_base (564)..(564): a, c, t, g, unknown or other
  misc_feature (564)..(564): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagaggtgtccagtgtgaggtgcagctggtggagtccgggggaggcgtgggtccagccgtgggggtccctgagactctcctgttcagcctctggtattcacctttagtaggttttggatgtagttgggtccgcgaggctccgaggggaggccgtggagtgggtgcaanatagagtacgagtaggaagtagaaagtaaaactgtagtacggacgtccggtaggaacggggacctagttaccgacctatcctacccgaaggacaaacgaaacgaacgtaaaagtaatttaacgtgtaactcgtaggaactaaaagtgaagctaacgctagacggagaccgtaggaccacggtntaagtgtagtacgtgcgagagaag

SEQ ID NO: 337014 - DNA, 658 bp, Homo sapiens
  misc_feature: GZ8MTXP02JPSZB.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtattttagaaggtgtccagtgtgaggtgcagcgtggtggaggtccgggggaggcgtggggtccaggccggtcgggggtccctggacgactctcctgttcagcctcgtggtattctaccgttttaggttaggttttggagttggtaggtttcggggtcccgccgaggccgtaccggaaggggacggggtccgtggggaggtggggtacggaccaaacgagtaggacgtacgagtaggaagtagaaagaaaactagtgtaggacgtccggtaggaacgggccgtattccgaaccacttccaccgaaggacgaaacgaaacgaacgtaaagtaatttagagttactactagaactaaaagtgacgactacggaccctaggaacggacgacccgggaggaaccgaccgggtcgttaaggttagttaagtttgtaggtacggtacgaagtaaag

SEQ ID NO: 337015 - DNA, 580 bp, Homo sapiens
  misc_feature: GZ8MTXP02H83BJ.2.81.H04.1.454.CMB.2.raw
  modified_base (421)..(421): a, c, t, g, unknown or other
  misc_feature (421)..(421): n is a, c, g, or t
  modified_base (551)..(551): a, c, t, g, unknown or other
  misc_feature (551)..(551): n is a, c, g, or t
  modified_base (570)..(570): a, c, t, g, unknown or other
  misc_feature (570)..(570): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctgggttttactgttggtattttagaggtgtccagtgtgaggtgcagctggtggaggtccggggagctgggtccagccgtgggggtccctgagactctcctgttcagcctctggattctacctttagtaggttttggatggagttgggtccgcgaggctccgaggggaggggcctgggaggtgggtggccaaacgatggagtacgagtaggaagtgaaagaaaaactntggtggtaacctccggtaggaaacggggtcccgagtttaccaacctatacctccgaagaacgaacaaacgactaaaggtactttaaggagtatctagacaaagtgagcagcctgacgacgccgaggaccnggactgtagtattacgtgngacgagtaag

SEQ ID NO: 337016 - DNA, 594 bp, Homo sapiens
  misc_feature: GZ8MTXP02I8U3K.2.81.H04.1.454.CMB.2.raw
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (461)..(461): a, c, t, g, unknown or other
  misc_feature (461)..(461): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgaggtgcagctggtggaggtccggggaggcgtggggtccagccgtgggggtccctgagactctcctgttcagcctctggtattctacctttagtaggtttggatgagttgggccncaggctcgagggaggctggagtgggngcaacatagagtacgagtaggaagtagaaagaaaactgtgtacggactccggtaggaacgggccagttaccacctatcctaccgagaanaaccaaacgactaaagtaatttagtacgtatctagaacgaaatggatcgaacgccgtagaaacggacggcccggaacggaacccgtcggtacttggttaagttattaagtttggacgaacggtaaggttaaag

SEQ ID NO: 337017 - DNA, 730 bp, Homo sapiens
  misc_feature: GZ8MTXP02HKH3M.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtattttagaaggtgtccagtgtgaggtgcagctgggtggaggtccgggggaggcgtggggtccgaggccggtgggggtccctggacgactctcctgttcagtcctctggtacttctacctttaggttaggttttggagttggtaggtttcgggtcccgccgacggccgtaccgaggggtaaggggccgtggggaggtggggtcggaccaacgagtaggagtaacgagtaggaagtaggaaagtaaaactagtgtacggtaccgtaccgggtaggaaacggggtccgtaacttaccaacccgtacttcccgtacccgaaaggaaccgtaaacgaaaaccggtaacgtaaaaggttaaagttttaaggtagttaaacgttccgtaaagtaaccgtaaaagttacggacgaaacgtaacggcccgtaagggaaacggacgggaacccgggaaacggaaccgaacgggtccgttaaggttagttaacgttttacggtaggtaggtaccggaaaggttaaaagg

SEQ ID NO: 337018 - DNA, 558 bp, Homo sapiens
  misc_feature: GZ8MTXP02IH7AY.2.81.H04.1.454.CMB.2.raw
  modified_base (306)..(306): a, c, t, g, unknown or other
  misc_feature (306)..(306): n is a, c, g, or t
  modified_base (436)..(436): a, c, t, g, unknown or other
  misc_feature (436)..(436): n is a, c, g, or t
tcagacgctcgacacacgaccggtgctcgatttagtagtgtagattcgcggggctgccctttggctttggagatggtttctcgatgggggctgggaggtctcagagaggagccttagcccctggactccaaggcctttccacttggtgatcagcactgagcacagaggactcaccatggaattggggctgagctgggttttacttgttggtattttagaggtgtccagtgtgaggtgcagctggtggaggtccggggaggcgtgggtccagccgtgggggtccctgagactctcctgttcagcctntggattctacctttagtaggttttggatggagttcgggtccgcgaggcctccgaggggaggggccgtaggggaggtggggtcggacccaaacgagtaggagtacgagtaggaagtgaaagaaaactgtgngactcggtagaaggcattcacatctcagagaacaacgacaagtatttagtgtatctagacaaatgagcaagcctaggacacggacgacggacagtcgtgtactagttagtgtcgacgataag

SEQ ID NO: 337019 - DNA, 579 bp, Homo sapiens
  misc_feature: GZ8MTXP02HITS9.2.81.H04.1.454.CMB.2.raw
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (500)..(500): a, c, t, g, unknown or other
  misc_feature (500)..(500): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgaggtgcagctggtggaggtccgggggaggcgtggggtccaggccgtgggggtccctgagactctcctgttcagcctcgtggtattctacctttaggttaggttttggattggtaggtttcggggtccgccgaggcctccggaggggaaggggccgtagggaggtggggtcggccaacgagtaggagtaacgagtagggaagtagaaagtaaaactgtgtaggactcggtgaacgggcatcacatcncaganacaacgacaagtattagngtatctagacaagtgagctagcctaggacgacgccgaggaccacggtctggtattagttagttggtagacggaagtaag

SEQ ID NO: 337020 - DNA, 643 bp, Homo sapiens
  misc_feature: GZ8MTXP02H47K3.2.81.H04.1.454.CMB.2.raw
  modified_base (550)..(550): a, c, t, g, unknown or other
  misc_feature (550)..(550): n is a, c, g, or t
tcagacgctcgacacacgaccggtgctcgatttagtagtgtagattcgcggggctgccctttggctttggagatggttttctcgatgggggctgggaggtctcagagaggagcccttagcccctggactccaaggccctttccacttggtgatcagcactgagcacagaggactcaccatggaattggggctgagctgggttttacttgttggtattttagaaggtgtcagtgtgaggtgcagcgtggtggaggtccgggggaggcgtggggtccaggcccgtgggggtccctgagactctcctgttcacgcctcgtggactttctaccttttaggtaggttttggattggtaggtttcggggtcccgccgaggcctaccggaggggaacggggccgtggggaggtggggtacggaccaaagagtaggagtaacggagtaggaaagtaggaaagtaaaaactgtaggtaggaccgttccggtaggaaacggggtacctaagttccaaccactcctaccaagacgaaaccaaacggacaaagtatttaggntactctagaactaaagtgaacgcacgccgtaggacgacggaccggagaccgacggtcgttgtagtttagttagtggtacgtacgaaaggtaag

SEQ ID NO: 337021 - DNA, 577 bp, Homo sapiens
  misc_feature: GZ8MTXP02JWHEF.2.81.H04.1.454.CMB.2.raw
  modified_base (481)..(481): a, c, t, g, unknown or other
  misc_feature (481)..(481): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgtggtttacgtgttaggtatttagaaggtgtccagtgtgaggtgcagcgtggtggagtccgggggaggcgtggggtccaggccgtggggggtcccctggagactctcctgttcagcctctggattcacctttagtaggtttggatgagttgggtccgcgaggctccgaggggaggcctggagtgggtgcaacagtagagtacgagtaggaagtagaaagaaaaactagtagttaggactaccggtgaaagggccgaagttccacattcgaccgagagaacaacgaaanaagttagtttagtagtactatagactaagtgacgacgacgcgagacgacgacggacgacgacgtgtaagtagttacttagtgtacggacgagtaag

SEQ ID NO: 337022 - DNA, 679 bp, Homo sapiens
  misc_feature: GZ8MTXP02F1RC8.2.81.H04.1.454.CMB.2.raw
  modified_base (220)..(220): a, c, t, g, unknown or other
  misc_feature (220)..(220): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttactgttggtatttagaggtntccagtgtgaggtgcagctggtggagtccggggagcgtgggtccaggccgtgggggtccctgagactctcctgttcagcctctggattctacctttaggtaggttttgagtggtaggttcgggtcccgccgaggcctaccgaggggaacggggccgtggggaggtggggtcgccaaacgagtaggagtacggagtagggaagtagaaagtaaaaactgtaggtaggacgtccggtaggaaacggggtacccgtatttacccgaaccctagttaccctacccaaaggaacgaaaccgaaacgaacgtaaaagttaaagtttagtacgttaatacgtagaacctaaaagtggaacgaccgtaacggacccgtaggaacggaaccggacccgggaaggaacccgacgggtaccttaaggttagtttaactttaccggtaggtaccggacggtaaggtaaaag

SEQ ID NO: 337023 - DNA, 703 bp, Homo sapiens
  misc_feature: GZ8MTXP02F02O0.2.81.H04.1.454.CMB.2.raw
  modified_base (306)..(306): a, c, t, g, unknown or other
  misc_feature (306)..(306): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaggtgtccagtgtgaggtgcagctgggtggaggtccggggaggctggggtccaggccgtgggggtccctggagctctcctgttcagcctntggtattcctacctttaggtaggttttggatggtaggtttcggggtcccgcgaggccgtaccggagggggtaaggggccgtgggagggtggggtacggaccaacgagtaggagtaacggaagtagggaagtaggaaagtaaaaacgttgtaggtaggtacgtacccggtaggaaacgggggtcccgaagtttaccaacccgtatcccgtacgaaacggaacgtaaaccaaacggtaactaaaggttaaaattttaggaacgttagttaccgtaggaaacaaagttagacggactaacggccgtaggaacggaaacggccgggaaacggaaccgacccgggttcgttaaggttacggtttaacgtttagttggttacggtaacgggaaggttaaaagg

SEQ ID NO: 337024 - DNA, 770 bp, Homo sapiens
  misc_feature: GZ8MTXP02F8PDO.2.81.H04.1.454.CMB.2.raw
  modified_base (219)..(219): a, c, t, g, unknown or other
  misc_feature (219)..(219): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattgggctgagctgggtttactgttggtatttagaggtntccagtgtgaggtgcagcgtgggtggaggtccgggggagctgggtccaggccgtgggggtccctggacgactctcctgttcagtcctcgtggtacttcaccgtttagtacggtttggatggtagttcgggtccgccgtaaggtccgtaccggaggggtaacggggtccccgtaggggtacggtcggggtacggaccctaaacgtagtacgggtaacgtacggtaagtacggggtaagttaggaaacgtaaaaacttgtaggttaacggacgtaccggtaggtaacgggtcccgaagtttccgaacccgtagttaccgtccgtaaaggtaaccgaaaccgtaaacggtaaccgtaaaacggttaacgtttaagggtacgttaacgttcgtaacggtaacgttaaaacggttcggtaaacggtacccgaacggttacccgtaaggggtaaacgtaaccggggtaccccggaacggggtaaacccgtaccgggtaccgttaaggttacgtttaaacggtttacgttcggtacggtaccggtaaaggttaaacgg

SEQ ID NO: 337025 - DNA, 619 bp, Homo sapiens
  misc_feature: GZ8MTXP02I0SF0.2.81.H04.1.454.CMB.2.raw
  modified_base (308)..(308): a, c, t, g, unknown or other
  misc_feature (308)..(308): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctggtttacttgttggtatttagaggtgtccagtgtgagtgcagcgtggtggaggtccgggggaggcgtgggtcccaggccgtgggggtccctggagactctcctgttcagcctntggtattctacctttaggttaggttttggattggtaggtttcggggtcccgccgtacgggcctacccggaagggggaacggggtcccgtggggaggtggggtacggaccgaaacgagtagagtaacgagtagggaagtagaaagaaaaactgtaggtaggaccgtccggtaggaaacgggccgtattaccaaccattccaccgaagacgaaaccaaacgacaaagtaagtttagacgtaatctagactaaatgagcaacgctaggacgagccggagacncggntgtattagttagtgtacgagaagtaaag

SEQ ID NO: 337026 - DNA, 687 bp, Homo sapiens
  misc_feature: GZ8MTXP02F3BQF.2.81.H04.1.454.CMB.2.raw
  modified_base (306)..(306): a, c, t, g, unknown or other
  misc_feature (306)..(306): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagaaggtgtccagtgtgaggtgcagctgggtggaggtccgggggaggcgtgggtccaggccgtgggggtccctgagctctcctgtcagcctntggtattctaccgtttagtaggttttggattggtaggtttcgggtcccgcgaggctccggaggggaggggccgtgggaggtggggtcggaccaaacgataggagtacggagtagggaagtaggaaagtaaaaactgtaggtaggaccgtcggtaggaacggggacgtacgttacacctacgtacctaccgaaaggaacgaaacgaaaaccgtaacgaaaagttaaagtttaagtacggttaattaccgttaggaaacttaaaacgaagggtacgaccgaacggtaccccgttagggaacggaaacgggacccgggaacgggaaaccgaccgggtacgttaaggttagttaactttagttaggtaggacggtaagtaaaagg

SEQ ID NO: 337027 - DNA, 622 bp, Homo sapiens
  misc_feature: GZ8MTXP02JIPT8.2.81.H04.1.454.CMB.2.raw
  modified_base (557)..(557): a, c, t, g, unknown or other
  misc_feature (557)..(557): n is a, c, g, or t
  modified_base (609)..(609): a, c, t, g, unknown or other
  misc_feature (609)..(609): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggaggtccgggggaggcgtggggtcccaggccgtgggggtccctgagactctcctgttcagtcctctggattctaccgtttagtaggttttggatggtagtttgggtccgcgaggctccgaggggaggggccgtgggaggtgggtcggaccaaacgagtaggagtaacggagtagggaagtagaaagtaaaaacttgtaggttaggaccgttaccggtaggaaacggggtccactttaccgacctagtcctacccgaagacgaaacgaaacgaacgtaaagtaagtttagtgtaatcgtagacaaatggancgacgccgtaggaacgacgaccggacggacgacggctaagtgttattagtgnggtacgagtaaag

SEQ ID NO: 337028 - DNA, 663 bp, Homo sapiens
  misc_feature: GZ8MTXP02JKXGC.2.81.H04.1.454.CMB.2.raw
  modified_base (543)..(543): a, c, t, g, unknown or other
  misc_feature (543)..(543): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggaggtccgggggaggcgtgggtccagccgtgggggtccctgagctctcctgttcagcctctggattctacctttagtaggttttggagtggagtttgggtccgccgaggcctccgaggggaaggggcccgtggggagtggggtcggaccaacgagtagagtacggagtagggaagtaggaaagtaaaaactagtggtacggacgttcccgggtaggaaacggggcccgtaatttcccaacccgtacttacctacccgaaagaaacggaaccaaaccggaacaaagtaattttaagngttaatccgttagacaaaagttgaagctaacggcctagggaaacggacgggacccggaacgggtaaccacggggtactggttaggttaaatttacgttggtgtaacggtaaggtaaaagg

SEQ ID NO: 337029 - DNA, 671 bp, Homo sapiens
  misc_feature: GZ8MTXP02HO7OR.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctgggttttacttgttggtattttagaaggtgtccagtgtgaggtgcagctgggtggaggtccgggggaggcgtgggtccaggccgtgggggtccctggagactctcctgttcagcctctggattctaccgtttaggtaggttttggatggtaggttcgggtccgccgacggtcctaccggaggggaacggggccgtggggaggtgggtcggccaacgagtaggagtacgagtagggaagtagaaagtaaaactgtaggtaggaccgtaccggaggaaacggggtccctaagtttccgaacctatacctacccgaaaggtaacgaaaccaaaacggaactaaaggttaaagtttagtaagttactacgttaggaactaaaagtcggaacgacgaacggccgttaggaacggacggacccggaaggaaccgtacggcgttaagggtattaacgttttagtggtacgacggtaagtaaag

SEQ ID NO: 337030 - DNA, 543 bp, Homo sapiens
  misc_feature: GZ8MTXP02JP676.2.81.H04.1.454.CMB.2.raw
  modified_base (454)..(454): a, c, t, g, unknown or other
  misc_feature (454)..(454): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtattttagaaggtgtccagtgtgaggtgcagctggtggaggtccgggggaggcgtggggtcccaggccgtggggggtcccctggagactctcctgttcagcctctggattctacctttagtaggttttgatgagttgggtccgcaggctccgaggggaggggcctggagtggggtgccaagatgagtacgagtgggaagtgaaagaaaactagtggtaggactcgtaggaagggccatcacatcnccagacacacgacaagtattagntatcngacaatgagcagccngagcgacgacgacgacggtctggtgtattacgtgtgacgaggtaag

SEQ ID NO: 337031 - DNA, 717 bp, Homo sapiens
  misc_feature: GZ8MTXP02HJY7T.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttacttgttggtatttagaaggtgtccagtgtgaggtgcagctggtggaggtccgggggaggcgtgggtccaggccgtgggggtccctgagactctcctgttcagcctgtggattctacctttaggtaggtttggatggtaggtttcgggtccgcgaggccgtccgaggggagggcccgtgggaggtggggtcggaccaacgagtaggagtacgagtagggaagtaggaaagaaaactgtaggtacggtaccgtaccgggtaggaaacggggtccctaagttccaacccgtagtccctaacccgaaggaaaccgaaaccgaaaaccgtaaactaaaaggttaaattttaaggacgttaataccgtagtaaacctaaaagttacggaacgaccgtaacggtacccggtaggaaacgggaaccggacccgggaaacggggaacccgtaaccggggttcgttaaggttaggtttaaacgttttaagggttccgggtacggtaaccggtaaggtttaaaaacgg

SEQ ID NO: 337032 - DNA, 604 bp, Homo sapiens
  misc_feature: GZ8MTXP02JUY24.2.81.H04.1.454.CMB.2.raw
  modified_base (223)..(223): a, c, t, g, unknown or other
  misc_feature (223)..(223): n is a, c, g, or t
  modified_base (308)..(308): a, c, t, g, unknown or other
  misc_feature (308)..(308): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtattttagaaggtntcagtgtgaggtgcagctgggtggaggtccgggggaggcgtggggtccaggccgtgggggtccctgagctctcctgttcagcctntggattctacctttagttaggtttggatggtaggtttgggtcccgcgaggctaccggaggggaggggccgtgggagggttggggtacggaccaaacgagtaggaggtaacgagtaggggaagtaggaaagaaaactgtagtggacgtccggtagaacggggcctagttaccacctatcctacaagacgaaccaaacgacaagtaatttagattatctagactaagtgatacgacgcctaggacgacggaccgacggacgacggtcgtggtagttatttagtgtagacggagtaaag

SEQ ID NO: 337033 - DNA, 633 bp, Homo sapiens
  misc_feature: GZ8MTXP02IEJ4X.2.81.H04.1.454.CMB.2.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
  modified_base (538)..(538): a, c, t, g, unknown or other
  misc_feature (538)..(538): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (591)..(591): a, c, t, g, unknown or other
  misc_feature (591)..(591): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagtcgttgggttttacttgttggttatttagaaggtgtcagtgtgagtgcagngtggtggaggtcggggngcgtggtcnggccgtggggtcccngagctctctgtcacgctctgattctaccgtttagtaggttttggagttgtaggtttcgggtccgtcgacgggcctaccggaggggaggggcccgtggggtaggtggggttcggacctaaacgataggagtaacgagtaggaagtagaaaataaaacgtatggacgggtactccggaggaaccgggtcctaattccgaaaccncttaccnccgaaagaacgaacgaaacgaacaaagttaatttagtatattanacgaataaangaacgncgtagtaggacgacggaccggaaaggacccgtacggnttaaggtacgtttaagttacgtggttacgacggaataaaagg

SEQ ID NO: 337034 - DNA, 741 bp, Homo sapiens
  misc_feature: GZ8MTXP02GFJX7.2.81.H04.1.454.CMB.2.raw
  modified_base (231)..(231): a, c, t, g, unknown or other
  misc_feature (231)..(231): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcccttttccacttggtgatcagcactgagcacagagactcaccagtggaagttggggctgagtcgttggttttacttgttaggttatttagaaggttntcagtgtgagtgcagcgtggtggacggtccggggagtcgtcgggtccgacggtccggtcggggtccctggacgtcctctcctgtcacgtcctgtcgtacttcgttacgtttaggttaggtttgtagttggtacggttcgggtcccgaccggacggtccgtaccggggaaggggacggtcgtgggtagggtggtacgaacctaaagttagaggtagtaaggtaagtaagggtaataaaggaaaagtaaaacttagtgtacggtacgtacgggaacggaacggtacctacttaccaacctactaccgaccgaaaggaaaccgaaaccgttaagaaaacgttaaagttaaaggtttactaaacggttattaaccggtaaagtaaacgtaaacgtaacgtaacgtaacgtaacgtacggtaacggaaacggtaaccggaaccgggtaacggtaccggtaacggttagttaagttacgttacgttacggttaggtacggtaacggtaacgtaaag

SEQ ID NO: 337035 - DNA, 572 bp, Homo sapiens
  misc_feature: GZ8MTXP02FVOHE.2.81.H04.1.454.CMB.2.raw
  modified_base (371)..(371): a, c, t, g, unknown or other
  misc_feature (371)..(371): n is a, c, g, or t
  modified_base (458)..(458): a, c, t, g, unknown or other
  misc_feature (458)..(458): n is a, c, g, or t
tcagacgctcgacacacgaccggtgctcgatttagtagtgtagattcgcggggctgccctttggctttggagatggttttctcgatggggggctgggaggtctcagagaggagccttagccctggactccaaggcctttccacttggtgatcagcactgagcacagaggactcaccatggaattggggctgagctgggttttactgttgtatttagaggtgtccagtgtgaggtgcagctggtggagtccggggggagctggggtccaggccgtggggggtcccctgagactctcctgttcagcctctggattcacctttagtaggttttgatgagtgggccgcaggctcgaggggaggggcctgggaggngggtggccaacgatagagtaacgagtgggaatgaaagaaaaaactagtagtggacgtccgtgaaacgggggtcccattcaaccctancctccagaagaacaaacgacaaagtaatttagtagtatactgacaaaatgagacagcctgacgacgccggaggtaccaacgggctgtagttattaagttcgtagacgaggaaag

SEQ ID NO: 337036 - DNA, 621 bp, Homo sapiens
  misc_feature: GZ8MTXP02JBGY9.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaagtgtccagtgtgagtgcagctggtggagtccgggggaggcgtggggtccaggccgtggggggtccctggagactctcctgttcagcctctggattctacctttagtaggtttgatgagttgggtcgcgagctccgagggagggcgtgggagtgggtggccaacgatagagtacgagtaggaagtagaaagaaaaactagtgtaggacctccggtaggaaacggggtccgaatttaccaaccgtaatccctaccgaaaggaacgaaacgaaacgaaccgaaaagtaatttaagagttaactcgtagaacgtaaaatcgaagacgacgccgtaggaacgacggaccggaacgacgaccggtctaaggtagttaacgtttagttggtacgtacggaaggtaaag

SEQ ID NO: 337037 - DNA, 703 bp, Homo sapiens
  misc_feature: GZ8MTXP02JYX5D.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtatttagaaggtgtcagtgtgaggtgcagcgtggtggaggtccgggggaggcgtgggtccagccgtggggggtccctggacgactctcctgttcacgtcctcgtggtatttcctaccgttttaggttaggttttggattggtaggtttcggggttcccgccgtaagggccgtacccggaagggggaacggggccgtggggtagggtgggggtacggacccgaaacgtaagtagggaacgttaacggagtaggggaaagtaggaaaagtaaaaacgttagtagggttacggaccgttacccgggtagggaaacggggcccgtaattaccgaaccctagttaccacccgaaggaacggaaccaaacggaacaaaagtaagttttaagagttagtacgtagaacaaaagtgagacgacgtacccgaggacggacgacccgggaacgaccgaacggctaaggttacgttagtttagttggacggtacgtaagaaag

SEQ ID NO: 337038 - DNA, 665 bp, Homo sapiens
  misc_feature: GZ8MTXP02I69JU.2.81.H04.1.454.CMB.2.raw
  modified_base (316)..(316): a, c, t, g, unknown or other
  misc_feature (316)..(316): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcttgggttttacttgttggttatttagaaggtgtccagtgtgaggtgcagcgtgggtggaggtccggggaggcgtggggtccaggccggtgggggtccctggacgctctcctgttcagtcctntggtacttctaccgtttagttaggtttggagttggtaggtttcgggtcccgccgaggtccgtaccggaaggggacggggtccgtaggggaggtggggtacgaccgaacgtagtagggaagtacggagtagggaagtaaggaaagtaaaactgtggtagaccgtcggtaaggaacggggcctactccaactacgtcctacgaaaggacgaaacaaacgaacgtaaagttaagtttagtagtactacgtagaactaaagtgaacgcgaaacggtccaggacggacggaccggacggtaaccgcggtaatgggttagttaacgtttcggtacggtagtacgaaagttaaacg

SEQ ID NO: 337039 - DNA, 587 bp, Homo sapiens
  misc_feature: GZ8MTXP02HRTI5.2.81.H04.1.454.CMB.2.raw
  modified_base (287)..(287): a, c, t, g, unknown or other
  misc_feature (287)..(287): n is a, c, g, or t
  modified_base (424)..(424): a, c, t, g, unknown or other
  misc_feature (424)..(424): n is a, c, g, or t
  modified_base (501)..(501): a, c, t, g, unknown or other
  misc_feature (501)..(501): n is a, c, g, or t
  modified_base (516)..(516): a, c, t, g, unknown or other
  misc_feature (516)..(516): n is a, c, g, or t
  modified_base (533)..(533): a, c, t, g, unknown or other
  misc_feature (533)..(533): n is a, c, g, or t
  modified_base (563)..(563): a, c, t, g, unknown or other
  misc_feature (563)..(563): n is a, c, g, or t
  modified_base (585)..(585): a, c, t, g, unknown or other
  misc_feature (585)..(585): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtcagtgtgagtgcagcgtggtggaggtccggggaggcgtgggtccagcccggtgggggtcccnggacgactctcctgttcacgcctgtggtcttcgtaccgttttagtaggtttgatggtaggtttgggtccgcgaggcctaccgaggggaggggctgggagtgggtcgccgaagagttaggagtaacgagtagggaagngaaagaaaactgtagtaggaacttcggaggaaacggggcccaattccgaacctatcctacgaaagacgacaaacganaaagtaaagtttagngtaatcgtagataaagngagacacgcgagacgacgacgacgcgacgntaagtgttactgtgcgacgtanag

SEQ ID NO: 337040 - DNA, 636 bp, Homo sapiens
  misc_feature: GZ8MTXP02JSTBK.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagctgggtttacttgttggtattttagaaggtgtccagtgtgagtgcagctggtggagtccggggaggctggggtccaggccgtgggggtccctgagactcctctgtcagcctctggattctacctttagtaggttttggatggtaggtttcgggtcccgcgaggcgtccgaggggaggggcctggggagtggggtggaccaacgagtagagtacggagtagggaagtagaaagtaaaaactgtagtacggactccggtaggaacggggcccgtaattaccgaaccctaatcctacccgaaggacgaaaccaaacggaactaaagtaaatttagtagttaatcgtaggaactaaaagtgaagaccaggaccctaggaacgacggacccggaacgggaccgaccggtcgtggtagttaatttaggttggtacggacgtaaggaaag

SEQ ID NO: 337041 - DNA, 786 bp, Homo sapiens
  misc_feature: GZ8MTXP02G6724.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcttgggttttacttgttggttatttagaaggtgtccagtgtgagtgcagcgtggtggaggtccgggggaggcgtggggtccaggccggtcgggggtccctggacgtactcctccgtgttcacgtcctcgtggtacttcgtaccgtttaggtaggttttgagtggtaggttcgggtccgacgtacggcctaccggaaggggtacgggcgtcgggaggtgggcggtaccaaacgtagtaggacgtaacgagtagggaagtagaaacgtaaaacgttagtaggtacggtaacgtccgggtaaggaaaccggggtcccgtaacttaccgaaccctacttcccgtaaccgaaaggaaccggaaaccgaaaacccggtaaaacgaaaagggtttaaacgtttttaaaggtaaggtttaccttacgttaaggaaaccgttaaaagtacgggtaaacgaccgggttaaactacccgggtaaaggacgggtaaaccgggaccccgggaaaaggggtaacccggtacccgggggtaactttaaggttaacgtttaaacgtttacggttttacgggacggtaacgggtaaaacgtttaaaaggg

SEQ ID NO: 337042 - DNA, 583 bp, Homo sapiens
  misc_feature: GZ8MTXP02JT55O.2.81.H04.1.454.CMB.2.raw
  modified_base (428)..(428): a, c, t, g, unknown or other
  misc_feature (428)..(428): n is a, c, g, or t
  modified_base (558)..(558): a, c, t, g, unknown or other
  misc_feature (558)..(558): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaggtgtccagtgtgaggtgcagctgggtggaggtccgggggaggcgtgggtccaggccgtggggggtccctgagactctcctgttcagcctctggattctacctttagtaggtttggatgagttgggtccgcgaggctccgaggggaagggccgtgggagtggggtgccaaacgataggagtacgagtagggaagtagaaagaaaaactntggtagacgtccggtaggaacgggccgtagttccaacctagtcctaccgagaacgaacaaacgacaaagtaatttagagttatactagacaaagtgagacacgtcctagacgacgcgaagtaccgacggntgtagtattagtgtgacgagtaaag

SEQ ID NO: 337043 - DNA, 731 bp, Homo sapiens
  misc_feature: GZ8MTXP02IT90M.2.81.H04.1.454.CMB.2.raw
  modified_base (713)..(713): a, c, t, g, unknown or other
  misc_feature (713)..(713): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggttattttagaaggtgtccagtgtgaggtgcagctggtggaggtccggggaggcgtgggtccaggccggtgggggtccctgacgactctcctgttcagcctcgtggtacttctacctttaggttaggttttggatggtaggtttcgggtcccgccgacggtccgtaccggaagggggtaacggggcccgtaggggtacgggtcggggttacggacccgtaaacgaagtaggggtagtaacggaagtagggaaaggttaggaaaaggtaaaaaactgttaggtacgggaaccgttccggtagggaaacggggccctaacgttacccgaaccctattccccgtaccaaaggtaaccgaaaccgaaaaccgtaacgtaaaagttaaagttttaagtacggttaaacttcttaggaacctaaaagtcgaacgactacggtccgtaaggacggaacggacccggaagggaccctaacggggtcttggttaagttagtttacgttaggnggtaacggtaagtaaaag

SEQ ID NO: 337044 - DNA, 663 bp, Homo sapiens
  misc_feature: GZ8MTXP02FWMK4.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaagtgtccagtgtgaggtgcagcgtggtggaggtccgggggagcgtgggtccaggccgtgggggtccctggagactctcctgttcagtcctctggattcctaccttttaggtaggttttggatggtaggttcggggtcccgccgaggtcctccggaaggggaggggtccgtgggaggtggggtcggaccaaacgagtaggagtaacgagtagggaagtaggaaagtaaaactagtgtacggactccggtaggaagggcctattccaacgaatcctaccgaagaacgaaaccgaaacgaataaaggttaatttacgtagttactacgtaggtaaactaagtgaaagcaacggtaccgtaggaaacggaaccgggaccggtaacggaaaccgccgggttacgttggttaacgttaattttacggttggacggaacggtaagtaaaag

SEQ ID NO: 337045 - DNA, 695 bp, Homo sapiens
  misc_feature: GZ8MTXP02FRKK1.2.81.H04.1.454.CMB.2.raw
tcagacgctcgacacacgaccggtgctcgatttagtagtgtagattcgcggggctgccctttggctttggagatggtttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgaggtgcagctgggtggaggtccgggggaggcgtggggtccaggccgtgggggtccctgagactctcctgttcagcctctggtattctacctttaggtaggttttggattggtagttcgggtccgccgaggcctcggaggggaaggggccgtgggaggtggggtcggaccaaacagtaggagtacgagtagggaagtagaaagtaaaaactgtaggtacggacgttccggtaggaaacggggtcccgtaactttaccaaaccctatacccgtacccgaaggaaacggaaaccaaaaccggtaaacaaaaggttaaattttaagggtattaacgttaccgttaggaaaccttaaaagtgaacgaccgtaaacgcccgtaaggacggaacggacccgggaaggaacccgaacggggttacgttaaggttagtttaacgtttagttggtacggaacggtaaggtaaag

SEQ ID NO: 337046 - DNA, 609 bp, Homo sapiens
  misc_feature: GZ8MTXP02JNTTE.2.81.H04.1.454.CMB.2.raw
  modified_base (238)..(238): a, c, t, g, unknown or other
  misc_feature (238)..(238): n is a, c, g, or t
  modified_base (581)..(581): a, c, t, g, unknown or other
  misc_feature (581)..(581): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctgggttttactgttggtattttagaaggtgtccagtgtgaggtncagctgggtggaggtccgggggagctgggtccaggccgtgggggtccctggagactctcctgttcagcctctggattctacctttagtaggttttggatggtaggttgggtccgcgaggctccgaggggagggcctgggaggtggggtcggaccaacagtaggagtacgagtagggaagtgaaagaaaactgtagtaggactccggtaggaaacggggcctacgttcaacccgtatccctaccgaaggacgaaaccaaaccgtaacaaaacgttaaagtttaggtagttaactctagactaaagtgaacgcgaacgccgtagacgagccgaagaccgacggtntggtgttaattatgacgtacgagtaaag

SEQ ID NO: 337047 - DNA, 662 bp, Homo sapiens
  misc_feature: GZ8MTXP02FS3CY.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgctggtatttagaaggtgtccagtgtgaggtgcagctggtggaggtccgggggagcgtgggtccaggccgtgggggtccctggacgactctcctgttcacgcctcgtgatttcctaccgttttaggtaggttttggagttggtaggtttcggggtcccgccgtacggctaccggaggggaacggggcgtggggaggtggggtacggaccaacgagtaggagtacggagtagggaaagtacggaaagtaaaactgtaggtacggacgtccggtaggaacgggccctattacccgacctactccgtaccgaagacgaaccaacgaacgtaaagtaagtttagagttatcgttagactaaagtcgagtacacggaccgtaggaacgacggacccggacggacccgaacgggtccgttagggttacgtttaacgttacgtttaggacggtacggtaaaacgg

SEQ ID NO: 337048 - DNA, 586 bp, Homo sapiens
  misc_feature: GZ8MTXP02G4X82.2.81.H04.1.454.CMB.2.raw
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (556)..(556): a, c, t, g, unknown or other
  misc_feature (556)..(556): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttactgttggtattttagaggtgtccagtgtgaggtgcagctgggtggaggtccgggggaggcgtgggtccagccgtgggggtccctgagactctcctgttcagcctctggattctacctttagtaggttttggatgagttgggtccgcaggctcgaggggaggctggagtgggngcaanagtagagtacgagtaggaagtgaaagaaaactagtggtcggtaactccggtaggaaacggggccgtaagttccaaccgtacttcctaccgaaaggacgaacaaacggacaaacgtaaatttagagttattactagacaaagtgagcgaacgccgtaggacgaggaccgagacgacggntgtagtattagttggtcgacgtaagtaacg

SEQ ID NO: 337049 - DNA, 595 bp, Homo sapiens
  misc_feature: GZ8MTXP02IMPTJ.2.81.H04.1.454.CMB.2.raw
  modified_base (218)..(218): a, c, t, g, unknown or other
  misc_feature (218)..(218): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttactgttggtatttagagtntcagtgtgagtgcagcgtggtggagtccggggagctgggtccaggccgtgggggccctgagactctcctgttcagcctctggnttctactttagtaggttttgattgagtttgggtccncaggctccgaggggaagggcccgtggaggtgggtacgacaacgagtaggagtaacgatagggaaagtagaaagaaaaactgtaggtagaaccgtccggtaggaaacgggtcccaagttaccaacccgtatccaccaaagacgtaacaaacgaacaaagtaaatttagatatctagacaaagtgacgacacgacctggacacggccggtaagacctaaccggtcgttaagtagttaagttactggtacgacgtaagaaa

SEQ ID NO: 337050 - DNA, 581 bp, Homo sapiens
  misc_feature: GZ8MTXP02IU23W.2.81.H04.1.454.CMB.2.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (514)..(514): a, c, t, g, unknown or other
  misc_feature (514)..(514): n is a, c, g, or t
  modified_base (545)..(545): a, c, t, g, unknown or other
  misc_feature (545)..(545): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaagttggggctgagcttgggttttacttggttggttattttagaaggttgtcagtgtgaggtgcagctgggtggaggtccggggagcgtgggtccaggccggtgggggtcccnggacgactctctgttcagcctntgacttctactttagtaggtttgatgagttcggtccncgagctcggagggaggctggagtgggcgacaacgatgagtacgataggaagtagaaaagtaaaactgtaggtacgaacgttccggaggaacgggtacgtacttccaacctatccgacgaagacgaaacaaacggtaataaagtatttaagagtatctagaanaagtgagcacgtcgagacgcgacgtagaccnggtactaagtagttaattagtgtagacgtaagaaag

SEQ ID NO: 337051 - DNA, 684 bp, Homo sapiens
  misc_feature: GZ8MTXP02JW7GR.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggccctttccacttggtgatcagcactgagcacagaggactcaccatggaattggggctgagtcgttgggttttacttgttggttattttaggaaggttgtccagtgtgaggtgcagcgtgggtggaggtccgggggagcgtgggtccaggccggtggggggtccctgagactctcctcgttcacgcctctgtagttcttaccgtttagtttaggttttggttagtgtaggttcgggttccggtcccgacggtcgtaccgtacggggaggggaccggtgggtaggtggggtacggaccgaaccgaagtagtaggtaacggtaggtaggtaagggtaacgaaagtaaaaacgtaaagtaggtacggtacgtaccggtaggtaacggggaccgtacgtactacccatcctaccgaaggacgaacgaaccgaagaaagtaagtttagtagtatactagataatagagacgacgtaccgagaaggacgaccggtaccggaacgtaacccggtgtaaggttgtttaagttagttacggttacgacggtaagtaaaacg

SEQ ID NO: 337052 - DNA, 635 bp, Homo sapiens
  misc_feature: GZ8MTXP02GA9Z1.2.81.H04.1.454.CMB.2.raw
  modified_base (225)..(225): a, c, t, g, unknown or other
  misc_feature (225)..(225): n is a, c, g, or t
  modified_base (610)..(610): a, c, t, g, unknown or other
  misc_feature (610)..(610): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtctgggttttacttgttggtattttagaaggtntccagtgtgaggtgcagctgggtggaggtccgggggagcgtgggtccaggccgtgggggtccctggagctctcctgttcacgtcctgtggtacttccgtaccgttttaggttaggttttggattggtaggtttcgggccgccgaggccgtaccggaaggggaggggtccgtggggaggtggggtacggaccaaacgtagtaggagtaacgagtagggaagtagaaagtaaaactgtggtaggaccgtcggtaggaacgggtcctaattccgaacctatcccgtacgaaagaacgaaaccaaacgaataaaggttaatttagtagttaatcgtagaactaaagtgaagtcgaacgccgtaggacggacggaccggagacgacggtntgttatagttagtgagacgataaag

SEQ ID NO: 337053 - DNA, 731 bp, Homo sapiens
  misc_feature: GZ8MTXP02FZ4CI.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttactgttggtatttagagtgtcagtgtgagtgcagctggtggaggtccggggaggcgtgggtccagccgtgggggtccctgagactctcctgttcagcctctggattcctaccgttttagttaggttttggatggtagtttgggtcccgcgaggctccgaggggaaggggccgtgggagtggggtcgaccaacgagtaggagtacgagtagggaagtagaaagtaaaactagtggtacggtacctaccggtggaaacggggtcccgaagtttcccaaccgtactaccgtaccaaagggaacgaaacccgtaaacggaaacctaaagggttaaaacttttaaggtaacgttaacgttaccgtagtaaaacctaaaagttcggaaacggtaccaaacgggtccccgttaaggggaaacggaaccgggtaaccccgggaaacggggaaaccccggtacggggtacccgtttaagggtttaggtttaaaccgtttttaacggttcggggtcggaacgggtaaaaggtttaaaagg

SEQ ID NO: 337054 - DNA, 630 bp, Homo sapiens
  misc_feature: GZ8MTXP02GI0CZ.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagaaggtgtccagtgtgaggtgcagctggtggaggtccgggggaggcgtgggtccaggccgtgggggtccctgagactctcctgttcacgcctcgtggattctaccgtttaggtaggttttggatggtaggtttgggtccgccgaggcctccgaggggagggccgtgggaggtggggtcggaccaacgagtagagtacgagtaggaagtagaaagaaaactgtggtagactcggtagaacgggcagttccacgtatcctaccgaagacgaaaccgaacgacaaaagttatttagagttactcgtagaacaaagtggaacgtacaacgtccgtaggaacggaacggacccggaaggacccgtaacggtcgttaaggttacgttaagtttacgttaggtaggaacggtaaggtaaaag

SEQ ID NO: 337055 - DNA, 662 bp, Homo sapiens
  misc_feature: GZ8MTXP02G35MU.2.81.H04.1.454.CMB.2.raw
  modified_base (539)..(539): a, c, t, g, unknown or other
  misc_feature (539)..(539): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggtttactgttgtatttagagtgtccagtgtgagtgcagcgtggtggaggtccggggagcgtgggtccaggccggtcggggggtccctggacgtactcctccgtgttcacgtcctcgtggtacttcctaccgtttagtaggtttggattggtaggttcgggtccgcgacggtccgtaccggaggggaagggccgtggggagttggggtcgacctaagagtaggagtacgagtaggaagtacgaaagaaaactgtgtacggactccggtaggaacgggtccagttaccaacctaagtccctaccgaagaacgaaaccaaacggtaactaaaagttaagttttaagngttaactcgtagaaactaaagtggaacgcgaacggtccgaaggaacggaacggacccgggaaaggaaccgccggttcgttaagggttattaacgtttacgtggtaacggacggaaagtaaaag

SEQ ID NO: 337056 - DNA, 687 bp, Homo sapiens
  misc_feature: GZ8MTXP02JK4XB.2.81.H04.1.454.CMB.2.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (623)..(623): a, c, t, g, unknown or other
  misc_feature (623)..(623): n is a, c, g, or t
  modified_base (659)..(659): a, c, t, g, unknown or other
  misc_feature (659)..(659): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttactgttggtatttagaaggtntccagtgtgaggtgcagctgggtggaggtccgggggagcgtgggtccaggccgtgggggtcccngacgactctcctgttcacgtcctcgtggtacttctaccgttttaggtaggttttgagtggtaggttcgggtccgcgacggcgtaccggaggggtaacggggtcccgtaggggtacgggtcggggtacggaccgaaacgtaagtagggtaacgtaacggaaggttacggggaaaggttaaggaaacgtaaaaacgttgtggtacggtacccgtcgggtagggaaaccggggtccgtacttaccgaacctcttaccgaccgtaaaggaaccgaaaccaaaaccgggaaataaaaggttaacttttaaggagttaactaccgtagaaactaaagtacgtanacccgtagccgtagacggacgacggacgtacgcgtntggtattattagtgacgtacgagtaaag

SEQ ID NO: 337057 - DNA, 739 bp, Homo sapiens
  misc_feature: GZ8MTXP02JT64Z.2.81.H04.1.454.CMB.2.raw
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtattttagaggtgtccagtgtgaggtgcagcgtggtggaggtccgggggaggcgtgggccaggccggtgggggtcccngngctctcctgtcacgcctcgtgtattctaccgtttaggtaggtttggagttgtaggttcgggtccgccgaggccgtacggaaggggacggggtccgtaggggtaggtggggtacggaccaaacgagtagggacgtaacggtagtagggaagtacggaaaagtaaaacgttagtaggtacggtaccgttacgggtagggtaaccggggtacctacgttacccgaacctaccgtacccgtaccgaaacggtaacggaaacccgaaaaccggtaaacgtaaaagggttaaagttttaacggtaaggtttaaccttaccgtaaggaaacctaaaggttagaacgtacgaaccggtaccggtaggacggaacgggaccgggtaacgggaacccgtacgggtacgttaaggttacgttaagtttacggttaggacggtaacggtaaggtaaaagg

SEQ ID NO: 337058 - DNA, 722 bp, Homo sapiens
  misc_feature: GZ8MTXP02FSVD5.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttgttatttagaggtgtccagtgtgaggtgcagcgtgggtggaggtccgggggaggcgtggggtccgacggtccggtcggggggtccctggacgtacctccgtcccgtgttccacgtcccttcgtggtacttcttaaccgttttaggttagggttttggagtggtaggttcgggtcccgccgtacggcctaccggaggggtacggggtccgtggggaggtcggggtacggacccaaacgtagtaggacgtaacggtagtagggaaagtaaggaaaacgtaaaaacttgtacggtaggtaaccgtaccgggtagggaaccggggtccctaacgtttacccaaccgtacttacccgtaccgaaaggaacgaaaaccgaaaccgtaaacgtaaaagttaaagtttaggtacgttaatacgtagaaactaaagtgaacgacgacggtcctagggaacgacgggaccgacggaaaccgcggtctaaggtagtttaacttagtcgtacggacgtagtaaaag

SEQ ID NO: 337059 - DNA, 595 bp, Homo sapiens
  misc_feature: GZ8MTXP02I5Z93.2.81.H04.1.454.CMB.2.raw
  modified_base (559)..(559): a, c, t, g, unknown or other
  misc_feature (559)..(559): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctgggttttacttgttgtatttagaggtgtccagtgtgaggtgcagctggtggagtccggggagctgggtcagccgtgggggtccctgagctctcctgttcagccctcgtggattctaccgtttagtacggttttggatggtagtttgggccgccgaggcctccgaggggaaggggcctgggagtgggtcgcaacgataggagtacgagtagaagtagaaagaaaaactagtgtacggtacgtaccggtggaaacggggtccgacgtttaccaccgtactacctacccgaagacgaacaaacggaacaaaggtaatttagatatactgtacaattgagcaagcctagacgaacgccggaggaaccncggacgtgtgtaacgttagtgtacggacgtagaaag

SEQ ID NO: 337060 - DNA, 589 bp, Homo sapiens
  misc_feature: GZ8MTXP02JWKL5.2.81.H04.1.454.CMB.2.raw
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtatttagaaggtgtccagtgtgagtgcagctgggtggaggtccggggagcgtggtcagccgtggggtccngagactctctgttcacgcctntgattctactttagtaggtttgatgaggttcgggtccgcgaggctccgaggggaaggggtcctaggggtagtggggtacggaccaaacgagtagagtaacgagtaggaagtaggaaanaaaaacgtgtaggttacggacttaccggtaggaaacgggtaccgattaccgaactattccacgaagaacgaactaaacggaacaaagtagtttaagngttaanctagacaaagtgagcagcagacgagaccgagacgacgtactgtatagttacgtgtacaggaagtaag

SEQ ID NO: 337061 - DNA, 627 bp, Homo sapiens
  misc_feature: GZ8MTXP02IHUV6.2.81.H04.1.454.CMB.2.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggccctttccacttggtgatcagcactgagcacagaggactcaccatggaattggggctgagcttgggttttacttgttggtattttagaggtgtccagtgtgaggtgcagctggtggaggtccggggagcgtgggtccaggccggtgggggtcctgagacctctcctgttcngtcctctggattctactttaggtggttttggntggnggttcgggtccgcaggccgtaccgaggggagggcctgggagtggtggaccaacgataggagtacgagtaggaagtagaaagtaaaaactgtagtggtaacgtcggtaaggaacgggtcctagttaccaactactaccgaccgaagaacggaacaaacgaacaaagtaagttttaagtagtaatacgtagaaactaagtagagacagtccgtaggaacgacggaccggacggaacctacgggtctaaggtttagttaacgtttggtacgtcggaacgtaaggtaaag

SEQ ID NO: 337062 - DNA, 622 bp, Homo sapiens
  misc_feature: GZ8MTXP02H5K23.2.81.H04.1.454.CMB.2.raw
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagacgctcgacacacgaccggtgctcgatttagtagtgtagattcgcggggctgccctttggctttggagatggttttctcgatgggggctgggaggtcccagagaggagccttagccctggactccaaggcctttccacttggtgatcagcactgagcacagaggactcaccatggaattggggctgagctggttttactgttggtatttagaggtgtcagtgtgaggtgcagctggtggaggtccggggagcgtgggtccaggccgtgggggtcccngagactctctgtcngcctntggattcactttagtaggtttgatgtagttcggtccgcgaggctcgaggggaggggctgggaggtgggngaccaacgagtagagtacgagtaggaagtagaaagaaaactgtaggtgaccgtccggtaggaacgggcccgtattcccgaacctaacgttccacccgaggaaacgaaacccgaaacgaaacgtaaagtaaattttaggtagttactcgtagactaaaagtgaagacgacgtaccgaggacggacgggaaccggacggaccgtacggtcgttaggtaagttagtttacgttcggtagacgtaaaggaagttaaa

SEQ ID NO: 337063 - DNA, 591 bp, Homo sapiens
  misc_feature: GZ8MTXP02FZX6Q.2.81.H04.1.454.CMB.2.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggtttttacttgttggttattttagaaggtntccagtgtgaggtgcagctgggtggaggtccgggggagcgtgggtccaggcggtcgggggtccctgagctctctgtcngcctntgtattctactttagtggtttgatgngtcggccgcgaggctcggaggggagggcgtggnggtgggcgacaanagtaggagtacgagtaggaagtagaaagtaaaactgtaggtaggacgtcggtaggaacgggtcctattaccactatccgacagaacaacaacgaacaaagttaattagntactnagaacaagtgagacacggccgtaggacggacggaccggaacggacccgaggtacttaaggttacgtttaagttacgttgtaggacgtaagtaaag

SEQ ID NO: 337064 - DNA, 683 bp, Homo sapiens
  misc_feature: GZ8MTXP02I3040.2.81.H04.1.454.CMB.2.raw
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccagtggaagttggggctgagtcgttgggttttacttgttggttatttaggaaggtgtccagtgtgaggtgcgagtcgtggtggaggtccggggagtcgtgggtccgaggtccggtggggtcccngagctctcctgtcngtcctcgtgtacttacttacgtttaggttggtttgtgtggtaggttcgggtccncgngccgtaccggaggggacgggccgtagggtaggtgggtacgacccgaatagtaggaggtaacgaggtaggaaggtaagaaaacgtaaaactgtacggtacgacgtacggtaggaacggtctacgtacaccgtataccgaccaaaggacaacgaaaccggtaataaagttaagtttagacttagtaccgtagaaactaagtacgaacgaccgtaagaccgtagggacggaacccggaacgggacggaccgttacggtaccgtttaaggttaacgtttagtttaacggttggaccgtaaacggtaaaggttaaaag

SEQ ID NO: 337065 - DNA, 621 bp, Homo sapiens
  misc_feature: GZ8MTXP02GCKML.2.81.H04.1.454.CMB.2.raw
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (579)..(579): a, c, t, g, unknown or other
  misc_feature (579)..(579): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattgggctgagctggtttacttgttgtatttagaggtgtcagtgtgaggtgcagctggtggaggtccgggggagcgtgggtccaggccgtgggggtccctgagctctcctgttcagcctctggattctactttagtaggtttgatgtagttggtccncgnggctccgaggggagggcgtggaggtgggtcgaccaacgagtaggagtacgagtagggaagtagaaagtaaaacgtagtaggtacggtacctaccggtaggaacgggtacccgtaattaccgaaccgtatacccgtaccgaaacggaacgaaaccgaaacgaacgtaaaagttaaacgtttagtacgttatacgtagaacaaagtgacgtacacgcctaggacgacggaccgtaggaccncggtataagttagttaagttcgtaggacgtacggtagtaaag

SEQ ID NO: 337066 - DNA, 669 bp, Homo sapiens
  misc_feature: GZ8MTXP02IE4T1.2.81.H04.1.454.CMB.2.raw
  modified_base (557)..(557): a, c, t, g, unknown or other
  misc_feature (557)..(557): n is a, c, g, or t
tcagacgctcgacacacgaccggtgctcgatttagtagtgtagattcgcggggctgccctttggctttggagatggttttctcgatgggggctgggaggtctcagagaggagccttagcccctggactccaaggccctttccacttggtgatcagcactgagcacagaggactcaccatggaagttggggctgagcttgggttttacttgttggtattttagagtgtcagtgtgaggtgcagctggtggaggtccggggagcgtggggtccaggtcccggtggggggtccctaggacgaccttccgtccctgttccacgtccctcgttggtatttccgttaaccgttttaggttagggtttttggattgggtaggtttcggggtcccgcgtacgggcctaccggaaggggaacggggtccgtaggggaggtggggtcggaccaaacgagtaggagtaacgagtagggtaaagtagaaaagaaaaacttgtgtaggtaaccgtcggtaggaacgggccgtattaccaacctatccacgaagaacgaaacaaacgtaanaaagttaatttagtagttaatcgtagaacaaagtgaagccaagtccgtagacgacggaccggaaaggtccgtacggtagtgtagtaatttacgtggtcggaagtaaggtaaa

SEQ ID NO: 337067 - DNA, 702 bp, Homo sapiens
  misc_feature: GZ8MTXP02IEHIS.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagagactcaccatggaattggggctgagcttgggttttacttgttggtatttagaaggtgtcagtgtgagtgcagctggtggaggtccggggaggcgtggggtcccaggccggtgggggtccctggacgactctcctgttcacgcctcgtggtacttctaccttttaggttaggtttggatggtaggtttcgggccgtccgaggtccgtaccggaggggaaggggcccgtaggggacgggtggggtacggaccgaacgtagtacggaggttaacgaagtaggggaaagtacgaaaagtaaaaacgtagttagggacgtaacgtccggtaagggaaacggggtccgtaacttccgaaccctagtcctaccgaaagacgaaacgaaacggtaataaaggttaattttaggagttaaattccgtaagaacctaaagcgaaagccaggtaccgtaggaaacgaaccgggaccgaaacgggaccgttaaccggtcgttaaggttacgtttaagtttagtacggtacgaacggtaaagtaaacg

SEQ ID NO: 337068 - DNA, 638 bp, Homo sapiens
  misc_feature: GZ8MTXP02JDO84.2.81.H04.1.454.CMB.2.raw
  modified_base (282)..(282): a, c, t, g, unknown or other
  misc_feature (282)..(282): n is a, c, g, or t
  modified_base (574)..(574): a, c, t, g, unknown or other
  misc_feature (574)..(574): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctggttttactgttgtatttagagtgtccagtgtgaggtgcagctgggtggaggtccgggggagcgtgggtccaggccgtgggggtcccngagactctctgtcagcctctgattctaccgtttaggttaggtttggatggtaggttcgggtccgcgacggccgtccggaaggggaggggccgtgggagtggagtcggaccaacagtagaagtacgagtaggaagtagaaagtaaaaactgtacggtaggacgttaccggtaggaaccgggctaagttcccaacctactccctaccgaagaaacgaaaccgaaaccggaactaaaaggttaatttaaggtacgttaactactaggaaacctaaagtgaacgtacgacgtaccnggaacgaccggacggaacggtacgacggtcgttaggtagttacgttagtggtacgaggtaaagg

SEQ ID NO: 337069 - DNA, 648 bp, Homo sapiens
  misc_feature: GZ8MTXP02FJF3R.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagcccctggacctccaaggcctttccacttggtgatcagcactgagcacagaggactcaccatggaattggggctgagtcttgggttttacttgttggttattttagaaggttgtccagtgtgaggtgcagcgtgggtggaggtccgggggaggcgtggggtccacggtccggtggggggtccctggacgtactcctcctgttcacgtcctcgtggtactttcctaccgttttaggttggttttggattggtaggtttcggggtcccgccgacgggtcctaccggaggggaggggccgtggggaggtggggtcgacaacgagtacgagtacgagtagggaagtagaaagtaaaactgtgtaggtactcggtaggaacgggtcccagttaccacctatcctacgaagaacgaaacaaacgaacgtaaagttaagtttagacttagtcgtagaactaaagtcgagtcaacgtctaggacgacggaccgaggaccgaggtctggttattagttagttgtacggacgtaagtaaag

SEQ ID NO: 337070 - DNA, 726 bp, Homo sapiens
  misc_feature: GZ8MTXP02GO9KS.2.81.H04.1.454.CMB.2.raw
  modified_base (692)..(692): a, c, t, g, unknown or other
  misc_feature (692)..(692): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccagtggaagttggggctgagtcgttgggttttacttgttggttatttaggaggtgtcagtggtgtaggtgcagtgtggtgggacgggtcgggggaggcggtggggtcccacggtccgggtcggggggtccctggacgtaccgtccgttccgttcgtccgacgtcctcgtggtacttccgttaccgttttaggttaggttttggagttcggtaggtttcgggtcccgaccggtgggtcccgtacggggaacgggggtaggggccggttagggggtaggtcggggtacggaccgtaaacgagtaggtacggtacggtaagtagggaaagtaagaaaagtaaaactgtaggtacggtacctacggtaggggacgggtacaacgtttccaacgtactaccgaccgaaaggacgaaaaccgaaacgtaaagtaaaagttaacgttagtattatacggtaacaaacgtaagtcgaaacgtcaacggtcgtaggaaacggaccgaacccggtaggaaccgcggtntaaggttagtacttagtcgaggacgtaaggtaaa

SEQ ID NO: 337071 - DNA, 664 bp, Homo sapiens
  misc_feature: GZ8MTXP02HRFUF.2.81.H04.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (353)..(353): a, c, t, g, unknown or other
  misc_feature (353)..(353): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcttgggttttacttggttggttattttagaaggtntcagtgtgaggtncagctgggtggaggtccgggggaggcgtggggtccaggccggtgggggtccctgagctctcctgtcagtcctgtggattcgtctttagtagtttggatgtaggttgggtccncgagctacggaggggaggggcctgggaggtgggcggaccaacgatacggagtacgagtacgggaaagtgaaaagtaaaactgtacgtaggacgttaccggtaggaaacggggtcccgattaccgaacctacgtaccctaccgaagaaccgaacgaaaacggtaaacaaaagtaaattttaggagttaacgtacttacgaataaaagtggaaacgtccaacggtaccgtaggaacggacggttaccgaaaacgggcgtaaccgggcttaaagggtttgttaacgtttacgtagtacggtacgtaaggtaaag

SEQ ID NO: 337072 - DNA, 654 bp, Homo sapiens
  misc_feature: GZ8MTXP02FTPUX.2.81.H04.1.454.CMB.2.raw
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (382)..(382): a, c, t, g, unknown or other
  misc_feature (382)..(382): n is a, c, g, or t
tcagacgctcgacacacgaccggtgctcgatttagtagtgtagattcgcggggctgccctttggctttggagatggttttctcgatggggggctgggaggtctcagagaggagccttagccctggactccaaggcctttccacttggtgatcagcactgagcacagaggactcaccatggaattggggctgagcgttgggttttacttgttggttatttagaaggtgtccagtgtgaggtgcagcgtggtggaggtccggggaggcgtgggccgagccggtgggggtcctgagctctcctgttcagtcctntggnttctacgtttaggttaggtttgatggtagttcgggccgcgtacggctacggaggggtaggcgtgggnggtgggtcgaccaacgagtagagtacgagtaggagtagaaagtaaaactgtggtaggactcggaagggaacggtaccgaacgtttacccaactcgtaccgtccgaaacgaacggaaaccctaaacgggaaaccttaaaagggtaaacttttaaggtacgttaacgttcaaacggtataaaagttcgaaagccgtaacggccgtagggaaacgacggaccggacggaccgaacggtgtaagttagtacgtttagtggtacgaggaagttaaag

SEQ ID NO: 337073 - DNA, 711 bp, Homo sapiens
  misc_feature: GZ8MTXP02F91VS.2.81.H04.1.454.CMB.2.raw
  modified_base (392)..(392): a, c, t, g, unknown or other
  misc_feature (392)..(392): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagtcgttgggttttacttgttggttatttagaggtgtccagtgtgaggtgcagtctgggtgggaggtccgggggaggtcgtcggggtccgacggtccggtggggggtcccctggacgacctccgttcctggttccacggtccttgtcggtacttcgttacctttaggtttaggttttgacttgggtacggtttcggggtccncggcggtccgtaccggaaggggtaacggggccgtaggggtaacgggtggggtacggacccgaaacgtaggtaggtacggttacgaaggttggggaaagtagaaaggtaaaacttgtaggtcggtactacgggtaggaaacgggtccgtacttaccaacccgtattacccgacgtaacgacgtaaaccgaacgaacgtaagttaatttacgagttactcgtagactaaagtgacgactcgaccgtaggaacggacgaccggaacgccggtaacggtcgttaagttacgttaagttacgttggacggtagtaaggtaaacg

SEQ ID NO: 337074 - DNA, 885 bp, Homo sapiens
  misc_feature: GZ8MTXP02HG9AR.2.81.H04.1.454.CMB.2.raw
  modified_base (784)..(784): a, c, t, g, unknown or other
  misc_feature (784)..(784): n is a, c, g, or t
tcagacgctcgacacacgaccggtgctcgatttagtagtgtagattcgcggggctgccctttggctttggagatggttttctcgatgggggctgggaggtctcagagaggagccttagccctggacctcccaaggtccctttccacttggtgatcagcactgagcacagagactcaccatggaattgggctgagtcttgggttttacttgttggttattttagaggtgtcagttgtgagtgcagtcgtgggtggagggtccgggggagcgtcgggtccgacggtcccgggtcgggggtcccctaggacgtacttcccttcccgttgttacccgacgtccccgtcgttggtacctttaccgtttaaccgttttaggtttagggtttttggagtttaggtaacggggttttcccggggtaccccgaccggaaccgggtccccgtaccggggaaagggggggtaaccggggtacccggtgggggtaacggggttccgggggtaccggaacccgaaaacgtagggttaacggggtaacgggtaaacggtaaacgggtaaggggtaaagttaaacggaaaaacggttaaaaaaacccgtggtttacggggtaaaccgggtacccgttaccgggggttaagggaaacccgggggtcccgttaacttaacccgaaccctacgtttacccgacgaaaacggtaaacgaaacccaaaacggtaataaaagtttaagtttagtacgtaaactccgtaaggaaacttaaaggagaacgcccggttaacggtccgnggaaaacggccgggaacccggttaaaacggccggaacccggttagtttgggttaacttttaacgttacggtttcccggcggtaaaaccgaaaggttaaaac

SEQ ID NO: 337075 - DNA, 760 bp, Homo sapiens
  misc_feature: GZ8MTXP02GLIFA.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttggttttacttgttggttatttagaggtgtcagtgtgaggtgcagcgtgggtggagggtccgggggaggcgtggggtccaggtccggtgggggtccctgagactcctctcgtcgacgtcctcgtgtacttcttaccgtttaggttaggttttaggtagttggtaggttcgggtccgcgtacggtcgtaccggaggggacggggccggtgggtaggtggggtacggaccgaacgagtaggaagtaacggtaggtagggtaaggtagaaagaaaaacttgtaggttacggacgttaccgggtaggtaaacggggtacctacttacaacccgtactacccgtaccgaaacggaaacgaaaccgaaaccggtaaaacgtaaaggtttaaaaggttttacgttaacgggttacttaacccggtaaggtaaactaaagttaagggaacgacttaaccgggaccgttagggaaacggacggaacccgggaacggtaacccggacggggtttacctaaggtttacgttaaaaggttttcggttaacgggacggtaacggaaacgggtttaaaag

SEQ ID NO: 337076 - DNA, 752 bp, Homo sapiens
  misc_feature: GZ8MTXP02HLJM4.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagtcacagaggactcaccatggaattggggctgagctggtttacttgttggtatttagagtgtcagtgtgagtgcagcgtggtggaggtccggggagtcgtgggtcaggccggtgggggtccctgacgacctctcccgtgttaccagtcctcgtggtactttcctaccgttttaggttacggtttggagttggacgtttcggggtccccgaccgtacggccgtaccggagggggtacggggtcccgtaggggaacggttggggtaccggacccaaaccgtagtacggtacgttaacggaggtagggaaagtaggaaaagtaaaaactgttaggtacggtaacttacccgggtagggtaaacggggtccgtaacgttacgaacccgtaacgttcccacgtaaacggaccgtaaaccgaaaacgtaaaccgttaaaaggttaaagttttaccggtagttacttaacccgaggtaaacccaaaagttcgaaacggtacaacggacccgtagaaacggacggacccggttaacggacccgtaacggtccttaagggttacttaaagtttaccttgggaccgtacggttaaaagtaaag

SEQ ID NO: 337077 - DNA, 552 bp, Homo sapiens
  misc_feature: GZ8MTXP02F2NGC.2.81.H04.1.454.CMB.2.raw
  modified_base (457)..(457): a, c, t, g, unknown or other
  misc_feature (457)..(457): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (549)..(549): a, c, t, g, unknown or other
  misc_feature (549)..(549): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttgtatttagaaggtgtccagtgtgaggtgcagctggtggaggtccgggggaggcgtggggtccaggccgtggggggtccctgagactctcctgtcagcctctggattcacctttagtaggttttggatggagttgggtccgcgaggctccgaggggaggggcctggagtggggtggccaacgatgagtacgagtaggaagtagaaagaaaaactgtgtaggactccggtagaaggggccaattcaacctntcctacaaggacaacaaacgacaaagtaatttagtactatctagacaaatgancanctagacgagcgagacncgntgtntattntgtgcganaag

SEQ ID NO: 337078 - DNA, 708 bp, Homo sapiens
  misc_feature: GZ8MTXP02IVLIX.2.81.H04.1.454.CMB.2.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (690)..(690): a, c, t, g, unknown or other
  misc_feature (690)..(690): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggtttacttgttggtattttagaaggtgtcagtgtgaggtncagcgtggtggnggtccgggggaggcgtgggtccaggtccgtcgggggtcccnggacgactctcctgttcacgcctntggtacttctacctttaggttaggtttggagttgtaggtttcgggtccgcctaggccgtacgaggggaaggggcgtgggaggtggggtcggaccaagtaacgtggtaacggtacgtagtagggaacgtaggaaaagaaaactagtcggtagtaccgtaccggtaggaacggggtacctagttccaacccgtaatccgtaccgaaacgtaacggaaaccgtaaaacgtaacggtaaaaacgtttaaaagtttaacgtaagtttaacgttacgtaacggtaaactaaaaggtttaggaaacgacgtacggtccgttaaagacggaccggacgggaacgtaacccggacggtcgttaaggtacgtttagttacggttgnggtaacgtaaggtaaaag

SEQ ID NO: 337079 - DNA, 631 bp, Homo sapiens
  misc_feature: GZ8MTXP02GSJ1B.2.81.H04.1.454.CMB.2.raw
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
tcagacgctcgacacacgaccggtgctcgatttagtagtgtagattcgcggggctgccctttggctttggagatggtttctcgatgggggctgggaggtctcagagaggagccttagccctggactccaaggcctttccacttggtgatcagcactgagcacagaggactcaccatggaattggggctgagctggtttactgttggtatttagaagtgtcagtgtgaggtgcagctggtggagtccggggagcgtgggccagccgtgggggccctgacgactctcctgttcagcctctggattctacctttagtaggttttggatgtagttgggtccgcagctcgagggagggctggngtgggcgacaanatgagtacgagtaggaagtcgaaagaaaactagtggagactaccggtaggaaacggggtccgagttaccacccgtaatcctacccgaaaggagaaacccgaaacgtaaccgaaaggttaaactttagtaacggttatacccgttaggaacctaaaagtgaaagggtctaaacggccccgttaagggacccggaagaccccgggaaagggacgttacccggacgttggtaggttatttaagtcggttacggacgaggtaacg

SEQ ID NO: 337080 - DNA, 695 bp, Homo sapiens
  misc_feature: GZ8MTXP02G9ZIP.2.81.H04.1.454.CMB.2.raw
  modified_base (674)..(674): a, c, t, g, unknown or other
  misc_feature (674)..(674): n is a, c, g, or t
tcagacgctcgacacacgaccggtgctcgatttagtagtgtagattcgcggggctgccctttggctttggagatggttttctcgatggggggctgggaggtctcagagaggagccttagccctggactccaaggcctttccacttggtgatcagcactgagcacagaggactcaccatggaattggggctgagcttgggttttacttgttggttattttagaaggtgtcagtgtgaggtgcagcgtggtggaggtccgggggaggcgtggggtcccaggcccggtcgggggtccctggagacctctccgtgttcagtcctcgtggtacttcctaccgtttagtaggttttggattggagttcgggtccgcgaggctcggaggggaaggggccgtgggagtggggtgaccaaagagtaggaagtaacgagtaggaaagtagaaaacgtaaaaactgtaggtacggaaccgttccgggtaagggaaacgggtacccgtaatttacccgaaaccctaacgtacccgtacccaaaggacgaaaaccgtaaaacggtaacaaaaggttaacttttaaggagttaaactcgtaacgtaacaaaagttggaaacgcctaaacggccctaggacgaaccgggacccgaaggacccgacggtgtaaggtacgtaacgtttagnggtacgacggtaaggtaaacg

SEQ ID NO: 337081 - DNA, 718 bp, Homo sapiens
  misc_feature: GZ8MTXP02JRHD7.2.81.H04.1.454.CMB.2.raw
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcgttgggttttacttgttggtatttagaagtgtccagtgtgaggtgcagctggtggaggtccgggggaggcgtgggtccnggccggtcgggggtcctgacgctccgtctgtcacgcctntggtattctaccgtttgtaggtttgatggtaggttcgggtacccgcgtacggccgtaccggaggggtacgggccgtggggnggtcggggtcgaccaaacgtagtaggtagtacgagtaggaaggtacggtaaagaaaaacttgtaggtacggaccgttaccggtagggaaacggggtacctaacgttcccaaacccgttacgtacccgtacccgaaggtaaaccggaaaccgaaacgtaaacgtaaaggttaaacgttttagagtttaacgtacggtagtaacgaaaaggtgaaacgtactaccgggtacgtacggggaacggaacggacccggggaaacggaaccgttcggggtacttaaggtagtttaacgtttaggtcggttaagacgggttaaataaaacggg

SEQ ID NO: 337082 - DNA, 884 bp, Homo sapiens
  misc_feature: GZ8MTXP02GCWSE.2.81.H04.1.454.CMB.2.raw
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggtttacttgttggtatttagagtgtcagtgtgaggtgcagcgtgggtggaggtccgggggaggcgtggggtccaggccggtcgggggtccctggacgtactcgtcctgttccacgtcctcgtggtacttcctaccgttttaggttagggtttttggaagtttggtacggtttcggggtcccgtaccggtacgggtccgtaccggggaaaggggggtaacggggtcccgttaggggtacggggttgggggtacgggaccctaaaaccggtaaagttacggggtaacggtaaccgggtaaaggttaagggggtaaaggtaaggtaaaaacgggtaaaaaaactttaggttagggttaaccggggtaaacccgttaccggggtaacggggtaaaaccgggggtacccgtaacgtttacccgaaacccgtacgttaccccgtaaccgaaacgggaaaccgtaaaaccgaaaaccgggtaaaaccgtaaaaaggttaaaacgtttttaaaggttaagtttaaacttacgttaaacggaaaccgttaaaagtacggaacggtaaccaacggtacccggttaaaggaaccgggaaccgggaaccggggaacgggaaacccggtacccgggtacgtttaacgggttaacggtttaaactttaacgggttgttacggaacggtaaaaggttaaaaag

SEQ ID NO: 337083 - DNA, 822 bp, Homo sapiens
  misc_feature: GZ8MTXP02JXLXJ.2.81.H04.1.454.CMB.2.raw
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagagactcaccatggaattggggctgagtcgttgggttttacttgttggtatttagaggtgtcagtgtgaggtgcagcgtgggtggaggtccggggngtcgtcgggtccaggccgtcgggggtccctgacgtctccgtccgtgtcncgcctcgtggtacttctaccgtttaggttaggtttgagttggtacggttcgggtccgccgacggtccgtaccggaggggtaggggccggttaggggtacggggtcggggtacggccgtaaaacgtagtacgggtacgttaacggtagttagggaaagggttaacggaaaagttaaaaaacgtgggttaaggttaccggacccggtttacccggagggggtaaacccggtcccggttaacttacccgaacccgtacgttccgaaccgaaacgggtaaactaaaccccggaaaaccgtaacgtaaaacgggtttaagttttaacgggttaattaaccgttcgtaaacggtaaaccgtaaaaggttcggaaaacggttccgaacggtacccgggttaggaaccgggaaccgggaccggggtaaacggtacccgggtaacggggttccgttaacggtttaaacggggttaagttttcggggtttaaccgggtacgggtaacgggtaaagttaaacgg

SEQ ID NO: 337084 - DNA, 687 bp, Homo sapiens
  misc_feature: GZ8MTXP02GSQCU.2.81.H04.1.454.CMB.2.raw
  modified_base (297)..(297): a, c, t, g, unknown or other
  misc_feature (297)..(297): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattgggctgagctgggttactgtggtatttagagtgtccagtgtgagtgcagctggtgagtccggggagctggtccagccgtggggtccctgagctctcctgttacagcctctggtnttctaccgttttagtaggttttggacgtgtagttcgggtccgcgtaggtctccgagggtaggggccccgttggaggtcggggtaggaccaaaccgtagttacgacggttaacggagttaggaaagttggaaaaggtaaaaccttagtcggttaacggacctacccgggtagaaacgggggttccccaagtttaccgaaccctagttccctacccgtaaagtaacgaaacgaaacccggttaagaaaccgggtaaattttagagtttaaccgactttaggaaccaaacgttagtacgacgtaacgtcccggtacggaacgtacggtacggacgaccgaaccggtccgtaacgttacgtacgttacgttgtttacgggtacggtacggtacg

SEQ ID NO: 337085 - DNA, 628 bp, Homo sapiens
  misc_feature: GZ8MTXP02IPP67.2.81.H04.1.454.CMB.2.raw
  modified_base (313)..(313): a, c, t, g, unknown or other
  misc_feature (313)..(313): n is a, c, g, or t
  modified_base (551)..(551): a, c, t, g, unknown or other
  misc_feature (551)..(551): n is a, c, g, or t
tcagacgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagcttgggttttacttgttggtattttagaaggtgtccagtgtgaggtgcagctgggtggaggtccgggggagcgtggggtccaggccgtggggggtccctggagactctcctgttcagcctntggattctacctttagtaggttttgattgagtttgggtcccgcgaggctacgaggggaagggtccgtggggagtggggtcggaccaaacgagtagaagtacgagtagggaaagtagaaagtaaaaactagtgtaggacgtaccggtaggaaacggggccgtaagttaccaccgtataccgtacccagaacgaaccaaacgaactaaagtaatttaagagttatactgaacaaagtganctagacctggaacgacggccggaaggaccgaacggtcttaaggtcgttaagttacgtttgacggtacgtaagtaaag

SEQ ID NO: 337086 - DNA, 508 bp, Homo sapiens
  misc_feature: GZ8MTXP01AZKNE.44.15.B04.1.454.CMB.2.raw
tcagacagtatatacacgaccggtgctcgatttagacagtatatatccgcggggaagctctgcttcagctgtgagcgcagaaggcaggactcgggacaatcttcatcatgacctgctcccctctcctcctcacccttctcattcactgcgcagggtcctgggcccagtctgcattgacgcagccgcctcagtgtctgcggccccaggacagagcgtcgccatctcctgctctggaacaactcaacatgcgtaatcatgttacatggtaccaaaaagtcgctggctcggcccctaaagtcctcatttatgagaatcttagaccgcccactggatctctgccgattctctgcctctaaagtctggaacttcagccaactttggcccatcaccggactccagactggagacgagccgatactattgtggctggactccgagccgtggtgttggggtttcgcggtagggaccgacgttgaccgtctaagtcaggcccaggtcttcgtccccg

SEQ ID NO: 337087 - DNA, 506 bp, Homo sapiens
  misc_feature: GZ8MTXP01DW5J2.44.15.B04.1.454.CMB.2.raw
  modified_base (224)..(224): a, c, t, g, unknown or other
  misc_feature (224)..(224): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (470)..(470): a, c, t, g, unknown or other
  misc_feature (470)..(470): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggtttcttctgagctgactcaggaccctgctgtgtctgtggccttgggacagacagtcacgatcacatgccaggganacagcctcagaggtcattatgcaagctggtaccagcagaagccaggacaggcccctgtccttgtcatctataggtaaaatgtcgccctnaggaactcccagaccgattctctgcctccacctcagganacacagcttctgaccatcacgtgggcncgagggcgaagntagacgcgtgactattactgtcgcgtcccggacaccgtagtcgtcacccaatcgttctagttcggcggtacgggaccgnggcgtgacccgtcgtaagcacgtcccgaagggtccc

SEQ ID NO: 337088 - DNA, 650 bp, Homo sapiens
  misc_feature: GZ8MTXP01BXBJI.44.15.B04.1.454.CMB.2.raw
  modified_base (247)..(247): a, c, t, g, unknown or other
  misc_feature (247)..(247): n is a, c, g, or t
tcagacagtatatacacgaccggtgctcgatttagacagtatatatccgcgggggaagctctgcttcagctgtgagcgcagaaggcaggactcgggacaatcttcatcatgacctgctccctctcctcctcacccttctcattcactgcgcagggtcctgggcccagtctgcattgacgcagccgcctcagtgtctgccggccccaggacagagcgtcgccatctcctgctctggaaacactcaacntgtcgtaatcatgtacataggtaaccaaaagtcgctggctccggacccctaaagtcctactactttatgaagtaatcttacgacccggacccctacgtggactctactacgccgtattcctctcgccttactaagtctggtacttcagcctagttcggacctatccaccggactccagacgtggaggacgaggacccgtattacgtagttcggttggtcgttacgggtaccgtccgtaagggttcccggtttgggggtcgggggtttcggggggtttttcccggggacggggtaaccgggggtaccccgttacggttccgggttaaccccgggtttaacccgtaaacggttcccgaacgggtacccccgttaaagggtccccgttcccgggttccccccccgg

SEQ ID NO: 337089 - DNA, 540 bp, Homo sapiens
  misc_feature: GZ8MTXP01EYZ8E.44.15.B04.1.454.CMB.2.raw
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
tcagacagtatatacacgaccggtgctcgatttagacagtatatatccgcgggggaagctctgcttcagctgtgagcgcagaaggcaggactcgggacaatcttcatcatgacctgcctcccctctcctcctcacccttctcattcactgcgcagggtcctgggcccagtctgcattgacgcagccgccctcagtgtctgccggccccaggacagagcgtcgccatctcctgctctggaaacactccaacatggtcgtaatcatgttacataggtaaccaaaaagtcgctggcctcggacccctaaagtcctcatttanganaatctagacccgcccactgatctactgccgtattcgtctcgcctctaaagtctaggaacttcacgcctacgtttgcccatcgacccggactccagactggaggacgaggcccgattactagttggtggcgttggtctcgngtccgttgggtgggttggggtttcggcggacgggacccgngttcgaccgtccgagtcacgcccaggccttcgcccccg

SEQ ID NO: 337090 - DNA, 545 bp, Homo sapiens
  misc_feature: GZ8MTXP01DURZE.44.15.B04.1.454.CMB.2.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (407)..(407): a, c, t, g, unknown or other
  misc_feature (407)..(407): n is a, c, g, or t
  modified_base (506)..(506): a, c, t, g, unknown or other
  misc_feature (506)..(506): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggtttcttctgagctgactcaggaccctgctgtgtctgtggccttgggacagacagtcacgatcacatgccaggganacagcctnagaggtcattatgcaagctggtaccagcagaagcaggacaggcccctgtccttgcatctataggtaaaatgtcgcctcaggaactcccagaccgattctactgcctcccacctcaggacgacacgacgccttccttacgaccactcgaacgtcggggcgacgacgggcggaaagngtacgacgtcgtacggtaacttattacgtgttcgccgtacccgggacacgtagtcgtccaccctaattcgttctacgttcgggtacgggacgggaccgnggcgtcgaccgtcgtaacgtcgacgtcccgaagtccccg

SEQ ID NO: 337091 - DNA, 649 bp, Homo sapiens
  misc_feature: GZ8MTXP01ANEO9.44.15.B04.1.454.CMB.2.raw
  modified_base (315)..(315): a, c, t, g, unknown or other
  misc_feature (315)..(315): n is a, c, g, or t
tcagacagtatatacacgaccggtgctcgatttagacagtatatatccgcgggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctggccggccccaggacagagcgtcgccatctcctgctctaggaaacactacaactatgtacgtatcatgtacatacgtaacaaaagtcgctgctccgaccctaagtcctactatttangatatcttacgacccggccctacgtggtactcctactacgccgtattccgtctcgtcctacgtaaacgttctacggtaacttcgtacgtcctacgtttcggacctacgtaccgaccggtactaccgaggacgtagggacggtaacggacgggtacctaacgtttacgtagttcgggttcgggacgtttacgggaccttccggtacggttcccggtttggggttcggggtttcgggggttttaccggcgggggtacgggtaaccccggttacggttcggaacccgttaaccgtaaggtccgacgaccccggaacgtcccgttccggttcccccgg

SEQ ID NO: 337092 - DNA, 603 bp, Homo sapiens
  misc_feature: GZ8MTXP01BTUB4.44.15.B04.1.454.CMB.2.raw
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (318)..(318): a, c, t, g, unknown or other
  misc_feature (318)..(318): n is a, c, g, or t
  modified_base (390)..(390): a, c, t, g, unknown or other
  misc_feature (390)..(390): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggttttcttctgagcgtgactcaggccctgctgtgtctgtggccttgggacagacagtcacgatcacatgccaggganacagcctnagagtcattangacaagctggtaccagcagaagccaggacacggcccctgtccttgcatctaataggtaaaatgtccggccctanacggaaccctccccgagaccctattcctacgtcggcctacccacctcgaaggacacactacgcctttcgtanacccatccgacggtggggccacggagggacgaaaggatacgacgtacgtacgtacttacttacgttcgtccgcccgtacccggactaccgtagtccgtaccctacctgtttcgttacgtacggttcggggacggaacggttaccgttcggttacgtaacccgggtaacccgttaacgtaacggtaccgacccggtaacccgttaaccggtccg

SEQ ID NO: 337093 - DNA, 669 bp, Homo sapiens
  misc_feature: GZ8MTXP01COD4E.44.15.B04.1.454.CMB.2.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgttggttttcttctgagcgtgacgtcaggccctgctgtgtctgtggccttgggacagacagtcacgatcacatgccaggganacagcctanagaggtcagttatgacaagcgtaggtaccagcaagaagccgaaggacctacgggcccccttgtcccttgtactactcgttaaagttaaggtaaaaaattcggtccggtacccctagaacgggtaaaccccttcccccgaagtacccgtactttcccgtaccgttcgggcccttcccgaaacccgtcgaagggacacaccgtacgtccctttacctacgacctatccgacggtcggggcgaccgagggacggaaagagtcggaccgtcggtacgtaacgttaattaccgttaggttccgcccgttacccgggaacctaccgtacggtcctacccaacccgtaattccgttcgtacggttccgggtaaccgggacgggacccgaggttcccgtaacgacccgttaacgtaacgcgaaccgtcccgaacgtccccg

SEQ ID NO: 337094 - DNA, 652 bp, Homo sapiens
  misc_feature: GZ8MTXP01BI6BP.44.15.B04.1.454.CMB.2.raw
tcagacagtatatacacgaccggtgctcgatttagacagtatatatccgcgggggaagctctgcttcagctgtgagcgcagaaggcaggactcgggacaatcttcatcatgacctgcctcccctctcctcctcacccttctcattcactgcgcagggtcctgggcccagtctgccctgactcagcctgcctcgtgtctggttctcctggacagtcatcaccatctctgcacgtggtccagcaatgacagtggatatactacttgtcctctgtatacaaacacactaccaggaccaaaccgcccccaaatctatttacgttttgacgtacagtggacgcggcctgtaaggttgtttcaagtcgtcttctcgtcggtctaccgtacgtcgtacggccaccgtaccggtcccttccccgtgttaccgtacgttcccgttcggtcggggtacccgttccccgggaccggttaggggtaacggggaccggtaacgggtccttaacggtaactttacgtaaccggtcgtccggtaccttacttaaacttaacctaaccgtttggttaacggacggttacgggttgggggttccggttcggggacggggtaacggtccttaaccgtaccggtccggttacccgtcgttcgggtaacccg

SEQ ID NO: 337095 - DNA, 559 bp, Homo sapiens
  misc_feature: GZ8MTXP01EVU82.44.15.B04.1.454.CMB.2.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggttttcttctgagctgactcaggccctgctgtgtctgtggccttgggacagacagtcacgatcacatgccaggganacagcctnagaggtcattangcaagctggaccagcagaagccaggacacggcccctgtccttgcatctataaggtaaaatgtccgcctacaaggaacctccagaccgtattccaacctgcctacccactcgaaggacgacactcgcctttcctgaacctatcgacggtcggggccacgacgggaccggaagacgtacggaacgcgtacggtaacttagttacgtcgttcgcccgtacccgggactacgtagtctaccacctaagttcttcgtacgttcgggcgggtaacggccgaggcgtaacgaccgttcgtaacgcgacgtccgaacggtccc

SEQ ID NO: 337096 - DNA, 670 bp, Homo sapiens
  misc_feature: GZ8MTXP01DY0J4.44.15.B04.1.454.CMB.2.raw
tcagacagtatatacacgaccggtgctcgatttagacagtatatatccgcgggggaagctctgcttcagctgtgagcgcagaaggcaggactcgggacaatcttcatcatgacctgcctccctctcctcctcacccttctcattcactgcgcagggtcctgggcccagtctgctattgacgcacgcccgccctcagtcgtctcggccggccccaggacagagccgtcgccatcctcctgcctactggaaaccaactccaaacagtggtcgtaatcatgttacatgtaacaaaaagtcgctgcctcgaccctaaagtctctattatgataatcttacgacccgcccactggactctcctgaaccgtattccgtctcgtcccttactaacgtcgtacggtacttcgacgcctaacgtttcggacctactccaacccgggacttaccccgagtaacgtcgggaacgggaacggtacgggtacccttaagtttaccgtatttggggtttcgggaaccgtttcgggtaaccttccgtaacggtcccgggtttggggtttcggggtttcgggggtttccgggttcggggtaccgggtaccccggttacggttcggttaaaccccggtcgtaaacgttccgcggacccgttaagggtcccgttccggttccccccgg

SEQ ID NO: 337097 - DNA, 577 bp, Homo sapiens
  misc_feature: GZ8MTXP01DS3FE.44.15.B04.1.454.CMB.2.raw
  modified_base (224)..(224): a, c, t, g, unknown or other
  misc_feature (224)..(224): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggtttcttctgagctgactcaggaccctgctgtgtctgtggccttgggacagacagtcacgatcacatgccaggganacagcctcagaggtcattatgcaagctggtaccagcgaagaagccaggaccacggcccctgtccttgcatctatagtaaaatgtcgcctnagactccagacgntctcngcncactnagacacacatcttctgaccatcacgtggggcacgagggaccggaagactaggaccgtacgtacggtaaccttagttacgtcggttacgcccgtacccggggaacacccgtaagttccgtacctaaccccgtaatttccggttacgttaacgttccggggacgggaacgggaccgaaggttcccgtaacggtaacccgttaaccggttaaacgcccgacgtccccgaagggttccccg

SEQ ID NO: 337098 - DNA, 590 bp, Homo sapiens
  misc_feature: GZ8MTXP01AMIYI.44.15.B04.1.454.CMB.2.raw
  modified_base (110)..(110): a, c, t, g, unknown or other
  misc_feature (110)..(110): n is a, c, g, or t
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (355)..(355): a, c, t, g, unknown or other
  misc_feature (355)..(355): n is a, c, g, or t
  modified_base (518)..(518): a, c, t, g, unknown or other
  misc_feature (518)..(518): n is a, c, g, or t
  modified_base (551)..(551): a, c, t, g, unknown or other
  misc_feature (551)..(551): n is a, c, g, or t
tcagacagtatatacacgaccggtgctcgatttagacagtatatatccgcggggagctgtgggctcagaagcagagttctggggtgtctccaccatggcctggacccctntctggctcactctcctcactctttgcatagattctgtggtttctctgagctgactcaggaccctgctgtgtctgtgccttgggacngacagtcacgatcacatcgccgaggganacagccctanaggtagtcattangcaagctaggtaccagcagaacgccgtaggacacggcccctgtccctgacatctagtaggtaaaatcggccgacctacgaggtaacccctcccgagacccgtattccncgtcggtcctccgacccgtgaacgggtacaaccacgtactcctttaccgtcgaaccgtatccgacggtcgggacgcgagggaccggaatacgcgtacgcgtagtactttaacgtcttcgtcggccctacccggggacctccgtaacgtcgttacaaccccgtnttcggttacgttacggttcgggcgggacgacgnggccgtaacgccgttaacgtacgcgaccgccgcgtcccg

SEQ ID NO: 337099 - DNA, 669 bp, Homo sapiens
  misc_feature: GZ8MTXP02GLEMR.44.15.B04.1.454.CMB.2.raw
tcagacagtatatacacgaccggtgctcgatttagacagtatatatccgcgggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgccggccccaggacagagcgtcgccatctcctgctctaggaaacactccaactatggtacgtaatcatgtacatagtaaccaaaagtcgctggctccggacccctaaagtcctactatttatcgagaatacgttagaccccggtacccaccgtggactctctgaccgtattctctacgcctactaaacgtctacgtaaaccttcacgtccctacgtttcggaccctacttaccgacccggtactacccgagtaccgtggaagacggagggaccctaagttacctaagttggttacgggtcgtttagggacctccgtacggtcccgtttgggggtttcggggtttacgggggttttcccgggacgggggtaacccggggtaccccggtaaccggttcggtaaaccccggttccgtaaaacggttccgaaaccggtccccgaaaacgggtcccgttacccggtcccccccggg

SEQ ID NO: 337100 - DNA, 487 bp, Homo sapiens
  misc_feature: GZ8MTXP02FRU72.44.15.B04.1.454.CMB.2.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (412)..(412): a, c, t, g, unknown or other
  misc_feature (412)..(412): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagggtctgtagtttcttctgggctgactcaggagtctgctgtgtctgtggccttgggacagacagtcaagatcacatgccacggagacagcctcagagggcactatgcaagctggtaccaacagaaagccgggacaggcccctntacttgtcatgtttggtaaaaacgccggccctcgggatcccagaccgattcnctgctcactcagaacncagctctgaccatcactggactcagcgaagatgaggctgactatattgcagcatccgggaanagtagtatgcttatgttcgcgaccggacagtcaccgtcttcgcacgccaacgccaacccactcacactctctccc

SEQ ID NO: 337101 - DNA, 519 bp, Homo sapiens
  misc_feature: GZ8MTXP02GS1OR.44.15.B04.1.454.CMB.2.raw
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggtttcttctgagctgactcaggaccctgctgtgtctgtggccttgggacagacagtcacgatcacatgccagggagacagcctcagaggtcattatgcaagctggtaccagcagaagccaggacaggcccctgtccttgtcatctataggtaaaaatgtcgcctcaggaactcccagaccgattcnctgcctccactcagagacacagcttcctgaccatcactggggcncagggcgaagatgacgctgactattacgtgtcgccgtcccgggacacccgagtcgtacaccctattcgttctacgttccggacgggtacgggaccagggctaacggacccgtcctaaacgtccaacggccccaaggtcccg

SEQ ID NO: 337102 - DNA, 669 bp, Homo sapiens
  misc_feature: GZ8MTXP02JE4B0.44.15.B04.1.454.CMB.2.raw
tcagacagtatatacacgaccggtgctcgatttagacagtatatatccgcgggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgcggccccaggacagagcgtcgccatctcctgctctggaaacaactccaacattggtcgtaatcatgttacatggtaaccaaaagtcgctggctccggcccctaaagtcctcatttatgagaatcttagacccggcccactgatctctgccgtattctctgccttctaagtctagtaacttcacgtcctacgtttcggccctactccgaacccggtacctacccgacgtaaccgtggggaacggaaccggacggggaccccgtaagtttaaaccgttaagtttcggtttcgggggtccgtttacgggggtaacccttcccgaggttccccgtttgggggttcggggttttcgggggtttttccggggaccggggtaacgggggtacccccggtaacggttccgggtaaccccggttccgttaaacggttccgaccggtaccccgaaacgggtcccttccggtcccccccgg

SEQ ID NO: 337103 - DNA, 612 bp, Homo sapiens
  misc_feature: GZ8MTXP02HA1EK.44.15.B04.1.454.CMB.2.raw
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggtttcttctgagctgactcaggaccctgctgtgtctgtggccttgggacagacagtcacgatcacatgccagggganacngccngagagtctatangacagctacgacagacaagaacgaccgaggacgaccggtcccctgtccttgtactactactaagtaaaggtaaaaacgtcggtaccgacctacgaacggaaccctacccgaacgtaccgtacttcgtcgtcgcctaccactacgaagacacactactccttacctacgacctacgtaccgacggtcgggaccgacggaacgggacggtaagacgacggacgtacgtacgtaacttagttacgtcgtaccgaccggtacccggaactaccgtacgtaccgtaccaccgtacgttacgttacgtacgtaccgggacggacggaccgacggtacgtaacgtaccgtaccgtacgacgaccgaccgacgccg

SEQ ID NO: 337104 - DNA, 562 bp, Homo sapiens
  misc_feature: GZ8MTXP02IQXST.44.15.B04.1.454.CMB.2.raw
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
tcagacagtatatacacgaccggtgctcgatttagacagtatatatccgcgggggaagctctgcttcagctgtgagcgcagaaggcaggactcgggacaatcttcatcatgacctgctcccctctcctcctcacccttctcattcactgcgcagggtcctgggcccagtctgcattgacgcagccgcctcagtgtctgcggccccaggacagagcgtcgccatctcctgctctggaaacaactcaacattggtctaatcatgttacatggtaaccaaaaagtcnctggctcggcccctaaaagtcctcattangagaatcttagaccgccactggatctctgaccgattctctgtcctactaaagttctagggtaaacttcaagtccaacttcggtccactacaccggacctaccacgacagagacgagacgactactaagtgttggtgttggtacgtcgtacgtccgttcggttgggttggggtttcgggttcgggtacgggtaccggaccgttacgaccgtaaccgtacgtacgacgaccgaaacgacgtcgtcccccgg

SEQ ID NO: 337105 - DNA, 542 bp, Homo sapiens
  misc_feature: GZ8MTXP02IV76G.44.15.B04.1.454.CMB.2.raw
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
tcagacagtatatacacgaccggtgctcgatttagacagtatatatccgcggggagctgtgggctcagaagcagagttctggggtgtctccaccatggcctggacccctctctggctcactctcctcactctttgcatagattctgtggttttcttctgagctgactcaggaccctgctgtgtctgtggccttgggacagacagtcacgatcacatgccagggagacagcctcagaggtcattatgcaagctggtaccagcagaagccaggacaggcccctgtccttgtcatctataggtaaaatgtcgcctgaggaactcccagaccgattctctcgctccacctcagagacacngccttcctgaccatcacgtggggcncgagggacgagatagacgtctagtactattacgtgttcgccgtacccgggacaccgtagtcgcaccctatcgttctacgttcgggacgggtacgggacccgtaggtacctaacggaccccgttacgttaaaacgtccgaaccggtacccgaacggtccccg

SEQ ID NO: 337106 - DNA, 531 bp, Homo sapiens
  misc_feature: GZ8MTXP01CBQSU.39.57.F02.1.454.CMB.2.raw
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
tcagtcgcactagtcacgaccggtgctcgatttagctcgatatagttgggtttggggaggcttggtacagccggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaaattccaaacagcacgcttgtatttgcacatgaaacagcctgagagccgaggacacggccatatattattgtncgaaactttctttgacttggttattatcccctagtgacactggggccaaagggaaccctggtcaccgtctcctcagcctccaccaagggcccatcgtctcccctgcaccctcnccaagcncncncggnggcgacacgcgccgcggcgngcgtgtcgaacgactaactcactagttgcgcngngcggcgtcggcgaggacgcaacgngn

SEQ ID NO: 337107 - DNA, 571 bp, Homo sapiens
  misc_feature: GZ8MTXP01B3DL4.39.57.F02.1.454.CMB.2.raw
  modified_base (571)..(571): a, c, t, g, unknown or other
  misc_feature (571)..(571): n is a, c, g, or t
tcagtcgcactagtcacgaccggtgctcgatttagctcgatatagttgggtttgggggaggcttggtacagccggggggtccctgagactctcctgtgaagcctctggattcacctttgacaagtgtgccatgacctgggtccgccaggctccagggaagggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaactttcctttgactggttattactcccctagtgacacgtggggccaagggaaccctggtcaccgtctcctcacgcctccaccaacgggcccactcggtccttccccctcggccaccctcctccaagacgcaccctcggtcgggggccacgacggccggccccgtggggcctcggcccgtgggtcaacgggcctaaccgttcccactacgttcgcgacttggcgcgggctgggcaagggcgcaagttgn

SEQ ID NO: 337108 - DNA, 554 bp, Homo sapiens
  misc_feature: GZ8MTXP01ANEKA.39.57.F02.1.454.CMB.2.raw
  modified_base (553)..(553): a, c, t, g, unknown or other
  misc_feature (553)..(553): n is a, c, g, or t
tcagtcgcactagtcacgaccggtgctcgatttagctcgatatagttgggtttgggggaggcttggtacagccggggggtccctgagactctcctgtgaagcctctggattcacctttgacaagtgtgccatgacctgggtccgccaggctccagggaagggctggagtgggtctcagttattagtggtagtggtagtagcacagattacgcagactccgtgaaggccggttcaccatctccagagacaattccaacagcacgctgtatttgcacatgaacagcctgagagccgaggacacggccatatattattgtgcgtaaactttccttttgacttggttattatcccctagtgacagtggggccaagggaacccctggtcaccgtctccctcacgcctccaccaagggcccatcggtccttcccctcggccaccctcctccaacgacgcacccgtcgtcgggggcacgacgccggcccgtgggctcgcctggtcaaaggctaacgtccactagcgcgacttgcgcgggctggcaacgggcgcgaattgng

SEQ ID NO: 337109 - DNA, 627 bp, Homo sapiens
  misc_feature: GZ8MTXP01C6Z2M.39.57.F02.1.454.CMB.2.raw
  modified_base (626)..(626): a, c, t, g, unknown or other
  misc_feature (626)..(626): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaacagcacgctgtatttgcacatgaacagcctgagagccgaggacacggccatatattattgtgcgtaaactttccttttgacttggttattactcccctagtcgaccacgtgggggcccaacgggaaccctggtccacccgtcctcctcacgccctacccaccaacgggccccactccggtccttcccccgtggcccacccctccctcccaaacgacgccacccgtcggtcgggggccaccgacggcccggcccgtcggggcctcggccgtggtaccaaacgggtccttaaccttcccacgttacgttcgaccgtacgttacggacggccggggcgtcgggccgaaacggggccgacgtaagttaaggng

SEQ ID NO: 337110 - DNA, 609 bp, Homo sapiens
  misc_feature: GZ8MTXP01ARX14.39.57.F02.1.454.CMB.2.raw
  modified_base (265)..(265): a, c, t, g, unknown or other
  misc_feature (265)..(265): n is a, c, g, or t
  modified_base (588)..(588): a, c, t, g, unknown or other
  misc_feature (588)..(588): n is a, c, g, or t
  modified_base (602)..(602): a, c, t, g, unknown or other
  misc_feature (602)..(602): n is a, c, g, or t
  modified_base (609)..(609): a, c, t, g, unknown or other
  misc_feature (609)..(609): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcacatctccagagacaattccaacagcacgntgtatttgcacatagaacagcctgaggagccggaaggacacggccaatatattattgtagacgtaaactttcctttagacttggttattactcccctagtcgacacgtcggggccaagggaaccctggtccaccgtctcctcacgcctaccaccgtaacggcccatccggtccttccccgtcggacccacccctccctaccaacgacaccgacccgttcggggtcgggggccaccgacggcccggtcccgtcgggcctcggcccgttggtacgaacggtactaaccttccgacgtacgcgcgtacgttcgacggccgggtcgnggcgaacggcgacngttaagn

SEQ ID NO: 337111 - DNA, 615 bp, Homo sapiens
  misc_feature: GZ8MTXP01DQJEN.39.57.F02.1.454.CMB.2.raw
  modified_base (615)..(615): a, c, t, g, unknown or other
  misc_feature (615)..(615): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaacagcacgctgtatttgcacatgaacagcctgagagccgagacacggccatatattattgtgacgtaaactttccttttagacttggttaacttactcccccttaagtcgaccacgttggacggaccccgggggaaaccctgggtaccacccggtctccctacacgccctcccaccaacgggcccacgtccggtccttccccctcggccacccctcctcccaacgacgccaccctcggtcgggggccacgacggccggcccgtcgggctcggccgttcgggtaccaaacgggacctaacttcccacgttagttcggcgacgttggacgcgggctgggcgaacgggcgacgaattaagn

SEQ ID NO: 337112 - DNA, 635 bp, Homo sapiens
  misc_feature: GZ8MTXP01ASEY2.39.57.F02.1.454.CMB.2.raw
  modified_base (634)..(634): a, c, t, g, unknown or other
  misc_feature (634)..(634): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaacagcacgctgtatttgcacatgaacagcctgagagccgaggacacggccatatattattgtgcgtaaactttcttttgacttggttattactcccctagtcacacgtcggggcccaagggaaccctggtccaccgtctcctcacgccctacccaccaacgggcccacgttccggttcccttcccccgtcggccctacccctccctaccaaacgcgacctacccgtccggggtcggggccaccgacggcccggtccccgtggggccttcggccgttcgggtacctaaacgggtcccttaaccgtttcccaacgttacgttccggacggtacgttcggcgggccggggtcgtgggaacgaacgggcgacaagttaagng

SEQ ID NO: 337113 - DNA, 675 bp, Homo sapiens
  misc_feature: GZ8MTXP01BQXW2.39.57.F02.1.454.CMB.2.raw
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (674)..(674): a, c, t, g, unknown or other
  misc_feature (674)..(674): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaacagcacgctgtatttgcacangaacngcctgagagccgaggacacggccatatattatgtgacgtaaactttcttttgacttggttattactccctagtcgacacgtggacggcccggggaaccctggtccacccgtctccctcacgccctacccacccgaacgggcccctacgtcccggtcccttccccccgtcggcccctaccccctccctacccgaaacgacgacccgtaacccgttccggggtcggggggcccaaccgacggcccgggccccgttcgggggctccgggtcccgttcgggtaccgtaaacgggtcccttaaacctttccccaaccgttacggttcggacccggtacccgttgggacgggccggggtcgtacggggaaccgaaagggccgacgtaagttaaggng

SEQ ID NO: 337114 - DNA, 622 bp, Homo sapiens
  misc_feature: GZ8MTXP01EEM4E.39.57.F02.1.454.CMB.2.raw
  modified_base (259)..(259): a, c, t, g, unknown or other
  misc_feature (259)..(259): n is a, c, g, or t
  modified_base (621)..(621): a, c, t, g, unknown or other
  misc_feature (621)..(621): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccgagggaaggggctggagtgggtctcagttatagtggtagtggtagtagcacagattacgcagactccgtgaagggccgttcaccatctccagagacaattccaanagcacgctgtatttgcacatgaacagcctgagagccgaggacacggcatatattattgtgcgtaaactttctttagacttggttattactcccctagtcgacacgtggggccaacggggaaccctggtccaccgtctcctcacgcctaccaccacgggccccagtccggtccttccccctaggccctacccctccctaccaaacgtcgcctaccgtcgggtcgggggcacgacgtcccggcccgtgggcctcggcctacgggtcctaaacgggacctaaccttccaacgtacggttcgccgtaacgttcgggaacggccgggggtaacgtacgggcgaacggggccgacgtaacgttaaggng

SEQ ID NO: 337115 - DNA, 621 bp, Homo sapiens
  misc_feature: GZ8MTXP01D6ZMF.39.57.F02.1.454.CMB.2.raw
  modified_base (285)..(285): a, c, t, g, unknown or other
  misc_feature (285)..(285): n is a, c, g, or t
  modified_base (590)..(590): a, c, t, g, unknown or other
  misc_feature (590)..(590): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
tcagtcgcactagtcacgaccggtgctcgatttagctcgatatagttgggtttgggggaggcttggtacagccggggggggtccctgagactctcctgtgaagcctctggattcacctttgacaagtgtgccatgacctgggtccgccaggctccgagggaaggggctggagtgggtctcagttattagtggtagtggtagtagcacagattacgcagactccgtgaagggccgttcaccatctccagagacaattccaacagcacgctgtattgcacatgaacngcctagagacgaccgaggacacggcctataatattattgtcgtacgtaaacttttctttagactttgttaattactccctagtacgacgacgtcggggcccaaacgggaaccctgggtccaccgtcctccctcacgtccctaccaccgaacggccctagtcccggttacccttcccccgtacggacccaccccttaccacccgaaagacccgaccacccgttcgggggtcgggggaccaacggcgccggtcccgtggctccgtcgtggtacacggtactaacctcacgtagcgacgacgttcggnggccggcgtggaacgaacggcgactaagngn

SEQ ID NO: 337116 - DNA, 785 bp, Homo sapiens
  misc_feature: GZ8MTXP01B3MD7.39.57.F02.1.454.CMB.2.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (784)..(784): a, c, t, g, unknown or other
  misc_feature (784)..(784): n is a, c, g, or t
tcagtcgcactagtcacgaccggtgctcgatttagctcgatatagttgggtttgggggaggcttggtacagccggggggggtccctgagactctcctgtgaagcctctggattcacctttgacaagtgtgccatgacctgggtccgccaggctccgaggggaaggggctggagtgggtctcagttattagtggtagtggtagtagcacagattacgcagactccggtagaacgggccgttcaccatctccaganacaatccaacagcacgctgttattgcacanagaacncgccgtgacgagaccggagacaccggacaatatattattgtagtacgttaaaccttttccttttagactttaggtttaacttaccgttaccccgttaaggtaccgaccgtacgggtcggggacccgtaaaccgggtaaccccgttcggtaccctacccgttcctcccctacgacccgtacccctacccgaacccggtaaccgggtcccctaacggttccccgggttccccctttccccccggtacggtacccctacccccgttacccacccgaaacgaccgtaccctaccccggtcggggggtaccgggggaccacccgggtaccgggccccgggttcccggtcgggggtcccgtaccgggtccccggttacggggtaaccccgtaaacgggttccctttaacccgttacccgacggtttaccgggacgtcccggtaacggttcgggaccgggttccggggccgttagggaaccgtaacgggcgacgtaagcgng

SEQ ID NO: 337117 - DNA, 662 bp, Homo sapiens
  misc_feature: GZ8MTXP01CE4O7.39.57.F02.1.454.CMB.2.raw
  modified_base (146)..(146): a, c, t, g, unknown or other
  misc_feature (146)..(146): n is a, c, g, or t
  modified_base (262)..(262): a, c, t, g, unknown or other
  misc_feature (262)..(262): n is a, c, g, or t
  modified_base (661)..(661): a, c, t, g, unknown or other
  misc_feature (661)..(661): n is a, c, g, or t
tcagtcgcactagtcacgaccggtgctcgatttagctcgatatagttgggtttgggggaggcttggtacagccggggggggtccctgagactctcctgtgaagcctctggattcacctttgacaagtgtgccatgacctgggtccnccaggctccgagggaaggggctggagtgggtctcagttattagtggtagtggtagtagcacagattacgcagactccgtgaagggccgttcaccatctccagagacaattccaaangcacgctgttattgcacatgaacagcctgagacgccgagacacggccatatattatgtgacgtaaactttctttgacttgttatactccctagtcgacacgtcgggaccaagggaccctggtccaccgtctcctcacgccctccaccacggccctacgtccggttcccttaccccgtcggcccctaccccgtccctaccgaacgtacgcccgtacccgtcggggtcgggggaccaaccggtaccggtcccggtccccggtggggcccttccggacccgtttacgggtacccgtaaacgggtacccttaacccgtttcccgaacgtttacggttcggaccggtcttacggggcggttacccggggcgtacgggaaccgaacgggccgaccgtaagttggng

SEQ ID NO: 337118 - DNA, 684 bp, Homo sapiens
  misc_feature: GZ8MTXP02J3CBN.39.57.F02.1.454.CMB.2.raw
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggcatanatatgngcaacttctttgactgtatatccctagtcacacgtggggccagggaccctgggtcacccgtctcctcgacgccctacccaacccgaaacgggcccaacgtccgggttccccttcccccgtcgggaccctacccccgttacccttaccccaaacgaccgacccgtaacccgttccggacggggggaccaaccgacgggacccggtcccgtccgggggtacctcggtcccgttagggttaccgaaaacggggtacccttaacctttacccgaaacctttaacgggtcggtaccggaccgttacgggtaacgggtaccggggtccgtacggggacccgaaaacgggggtcccgacgttaaacgtacgacg

SEQ ID NO: 337119 - DNA, 541 bp, Homo sapiens
  misc_feature: GZ8MTXP02HNCW9.39.57.F02.1.454.CMB.2.raw
  modified_base (541)..(541): a, c, t, g, unknown or other
  misc_feature (541)..(541): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaactttcctttgactggttatatcccctagtcgaccactggggccagggaaccctggtcaccgtctcctcagcctccaccaggcccatcgtcttcccctcggccaccctcctccaacgacgccacctcgtcgggggcacgagccgcccgtggctgcctggtcaaggactactccactacgtgcgacgtcgagcgggcgtcggcgaacggcgcatagn

SEQ ID NO: 337120 - DNA, 547 bp, Homo sapiens
  misc_feature: GZ8MTXP02F147E.39.57.F02.1.454.CMB.2.raw
  modified_base (547)..(547): a, c, t, g, unknown or other
  misc_feature (547)..(547): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaacagcacgctgtatttgcacatgaacagcctgagagccgaggacacggccatatattattgtgcgtaaaacttcctttgactggttattatcccctagtcgaccactggggccagggaaccctggtcaccgtctcctcagcctccaccaggcccatcgtctcccctgccaccctcctccaagcgccacctcgtcgggggcacgacgcgcccgtgggcctgccgtggtacgaacggacctacttccactacgtcgcgactcgacgcgggcgtggacgaacggcgacatagn

SEQ ID NO: 337121 - DNA, 533 bp, Homo sapiens
  misc_feature: GZ8MTXP02I0WTO.39.57.F02.1.454.CMB.2.raw
  modified_base (422)..(422): a, c, t, g, unknown or other
  misc_feature (422)..(422): n is a, c, g, or t
  modified_base (529)..(529): a, c, t, g, unknown or other
  misc_feature (529)..(529): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattcccaacagcacgctgtatttgcacatgaacagcctgagagccgaggacacggccatatattattgtgcgaaacttctttgactgttattatcccctagtgaccactggggccagggaaccctggtcaccatctcctcagcctccaccacggcccatcggtcttccccncggcaccctcctccagacgcacctcgtgggggcacgacgccggcccgtcgggctcgcctggtcaacggactacttccactagtcgcgactgacgcggctggcaggcncatg

SEQ ID NO: 337122 - DNA, 580 bp, Homo sapiens
  misc_feature: GZ8MTXP02FSGXB.39.57.F02.1.454.CMB.2.raw
  modified_base (579)..(579): a, c, t, g, unknown or other
  misc_feature (579)..(579): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgagacacggccatatattatgtgcaaacttcctttgactggttattactcccctagtcgaccacgtggggccagggaccctgggtccaccgtctccctcagccctccaccacggcccactccgtcccttcccccgtcggccctacccctccctcccaacgacgccacccgtcgtacgggggccacgacgccggccccgtgggcctcggccgtcggtacgaaacggactaccttccactacgtcgcgacgtcgacggcgggcgtcggacgacggcgacactagng

SEQ ID NO: 337123 - DNA, 612 bp, Homo sapiens
  misc_feature: GZ8MTXP02HLQO1.39.57.F02.1.454.CMB.2.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (611)..(611): a, c, t, g, unknown or other
  misc_feature (611)..(611): n is a, c, g, or t
tcagtcgcactagtcacgaccggtgctcgatttagctcgatatagttgggtttgggggaggcttggtacagccggggggtccctgagactctcctgtgaagcctctggattcacctttgacaagtgtgccatgacctgggtccgccaggctccgagggaaggggctggagtgggtctcagttatagtggtagtggtagtagcacagattacgcagactccgtgaagggccgtnaccatctcaganacaattccaangcacgctgtattgacacatgaacagcctgagagccgaggacacggcctaatatattattgtagcgtaaactttcctttagacttgttaatactccctagtcacctagtcggggaccacgggaccctggtcctaccgtctccctcacgccctaccaccgaacggcccacgtccgtccttcccccgtcgccctaccctcctaccgaacgacgcctaccgtcgcggggtcacgacgccgtaccgtgggctcggccgtacggtacgaaacggtacctaccgttcctaccgtaacggtcggaccgaaccgtcggaacggcgggtaaccgtggaccgaaacgggcgaccgaacgttacggng

SEQ ID NO: 337124 - DNA, 603 bp, Homo sapiens
  misc_feature: GZ8MTXP02FV0E2.39.57.F02.1.454.CMB.2.raw
  modified_base (259)..(259): a, c, t, g, unknown or other
  misc_feature (259)..(259): n is a, c, g, or t
  modified_base (602)..(602): a, c, t, g, unknown or other
  misc_feature (602)..(602): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccgttcaccatctccagagacaattccaanagcacgctgtatttgcacatgaacagcctgagagccgagacacggccatatattatgtgacgtaaactttcctttgacttgttattactcccctagtcgacctacgtggggccaggggaaccctggtccaccgtctcctcacgcctccaccgacggcccacgtccgtcccttccccgtcgccctaccctccctaccgaagacgaccacccgtcgtcgggggccaccgacggccggcccgtcgggccgtcggtccgttcggtacgaacggtaccttaccttaccgtacgtacggtacgacgacgtcggacggccgggtaacgtcggacgacggcgtcagtacgng

SEQ ID NO: 337125 - DNA, 637 bp, Homo sapiens
  misc_feature: GZ8MTXP02GJT7B.39.57.F02.1.454.CMB.2.raw
  modified_base (298)..(298): a, c, t, g, unknown or other
  misc_feature (298)..(298): n is a, c, g, or t
  modified_base (413)..(413): a, c, t, g, unknown or other
  misc_feature (413)..(413): n is a, c, g, or t
  modified_base (636)..(636): a, c, t, g, unknown or other
  misc_feature (636)..(636): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccaggggaaggggctggagtgggtctcagttattagtggtagtggtagtagcacagattacgcagactccgtgaagggccgttcaccatctcagagaactaattccaacagcacgctgttatttgcacatagaacagcctggaagngccggaggacacggccatatatttattgtgacgtaaactttctttagactgttatactccctagtcaccagtcggggaccacggggtaaccctgggtccaccgttctcccgtacncgtccctacccaacccgaacggtcccacgtcccggtcccttcccccgtacggcccctacccctaccccgtaccaaacgacgacctacccgtcggtaccgggggcaccggacggcccgggtcccgcgggtccgtacgtccgtcggtacgaacggtaccttaccttccgtacgttacgtcgcgacgtacggacggcgggccgtacggacgacggcgacgagtcgng

SEQ ID NO: 337126 - DNA, 609 bp, Homo sapiens
  misc_feature: GZ8MTXP02I4WNA.39.57.F02.1.454.CMB.2.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (385)..(385): a, c, t, g, unknown or other
  misc_feature (385)..(385): n is a, c, g, or t
  modified_base (608)..(608): a, c, t, g, unknown or other
  misc_feature (608)..(608): n is a, c, g, or t
tcagtcgcactagtcacgaccggtgctcgatttagctcgatatagttgggtttgggggaggcttggtacagccggggggtccctgagactctcctgtgaagcctctggattcacctttgacaagtgtgccatgacctgggtccgccaggctccagggaagggctggagtgggtctcagttattagtggtagtggtagtagcacagattacgcagactccgtgaagggccgttcaccatcncagnacaatccaanagcacgctgtatttgcacatgacagcctgagagccgaggacncggccatatattactgtgacgtaactttctttagaccttgttattactcccctagtcgaccacgtcgggcagggacctgggcaccgtcncctcacgtccacccaccgaggccctacgtccgtcccttcccccgtcgccctacccgtccctaccgaaacgcgttacccaccgtcggtcgggggaccacgacggccggtcccgtgggtctcggaccttcgggtaccaacgggtacccttaaccgttccagtaaccgggttcgaaccgtacgtacgggacgacggggttccggcggacgacggcgacgtagacgng

SEQ ID NO: 337127 - DNA, 682 bp, Homo sapiens
  misc_feature: GZ8MTXP02FUWLE.39.57.F02.1.454.CMB.2.raw
  modified_base (259)..(259): a, c, t, g, unknown or other
  misc_feature (259)..(259): n is a, c, g, or t
tcagtcgcactagtcacgaccggtgctcgatttagctcgatatagttgggtttgggggaggcttggtacagccgggggggtccctgagactctcctgtgaagcctctggattcacctttgacaagtgtgccatgacctgggtccgccaggctccagggaagggctggagtgggtctcagttattagtggtagtggtagtagcacagattacgcagactccgtgaagggccgttcaccatctccagagacaattccaacngcacgctgtatttgcacatgaacagtcctgagagccgaaggactacggcctatatattatgtcgacgaaaactttcctttagacttgtaacttactcccctagtcgaccacgtggggcccaaggggaacccctgggtaccaccggtctaccctcgaacgcccctaccaccaacgggcccctaagtccggttcccttcccccgtacggcccctaacccttccctacccgaaacgacggacctaaacccttccggtcgggggaccaaccgtaccgggtacccgggcccccgtgggggtacctcggtccgttccggaacgaaacgggtaccctaaccgttccaaacggttacgtcggaccgttaacgtcggaacgggcccgggtaacgtcgggaacccgaaggggttccgacctaaacggtacgcg

SEQ ID NO: 337128 - DNA, 445 bp, Homo sapiens
  misc_feature: GZ8MTXP01BB4L9.44.29.C07.1.454.CMB.2.raw
  modified_base (335)..(335): a, c, t, g, unknown or other
  misc_feature (335)..(335): n is a, c, g, or t
  modified_base (442)..(445): a, c, t, g, unknown or other
  misc_feature (442)..(445): n is a, c, g, or t
tcagacagtatatacacgaccggtgctcgatttagagtgctacgaagggaaagggctggtgtgggtctcacgtattaatagtgatgggagtagcacaagctacgcggactccgtgaagggccgattcaccatctccagagacaacgccaagaacacgctgtatctgcaaaatgaacagtctgagagccgaggacacggctgtgtattactgtgcaaagagccggtgcggggagttcggggattgcatactactactacggtatggacgtctggggccaagggaccacggtcaccgtctcctcagctccaccaaggcccatcggtcttcccctgcnccctgctccaggagccacctctgggggcacaagcggccctggggctgccctggtcaaaggactacttcctatatactgtctgagcgggctgggcaaggcgcagtagnnnn

SEQ ID NO: 337129 - DNA, 513 bp, Homo sapiens
  misc_feature: GZ8MTXP01DNVQJ.44.29.C07.1.454.CMB.2.raw
  modified_base (481)..(481): a, c, t, g, unknown or other
  misc_feature (481)..(481): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagcccccaggaaggcccgtcggagtggcttgcactcatttattggagtgatgataggcgctacagtcatctctgagagccagactctccactacaccgcgacgcctccaactacgacagtgatccttagagtggaccaacagtcggccctcgcggaccacacgccacactactacctgcgcacacatatatactaataattaataaagttggtgttagtgtgagttgttnttgtatcgtcggacgggacgaaggaacgtaag

SEQ ID NO: 337130 - DNA, 572 bp, Homo sapiens
  misc_feature: GZ8MTXP01A8PM2.44.29.C07.1.454.CMB.2.raw
tcagacagtatatacacgaccggtgctcgatttagagtgctacgaagggaaagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagctaatttcattggtaatcatgactatgtctctggtacagcatcaccaggcacacgccccagactcgtgtattttgaggtacaagtaagccgcccctcgacgggtcccgattcggtctccgtcggctaccgaagtcctaggacctaacgaccgtccctaccctcgaccgtctcgtcggcctcgaggctgacgagtgaggtctagtattatactgcaggtcgtcgatggacgctacgtagtgtagtttcgtcgtttcggcgggtaaggccaggaccgttcgtaaccgtcgttacggttcgaccgccgtaacgggcctccggcccccgttcgtaaccgttccttcccg

SEQ ID NO: 337131 - DNA, 529 bp, Homo sapiens
  misc_feature: GZ8MTXP01CR8CN.44.29.C07.1.454.CMB.2.raw
  modified_base (348)..(348): a, c, t, g, unknown or other
  misc_feature (348)..(348): n is a, c, g, or t
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagcccccaggaaggccctggagtggcttgcactcatttattgggatgatgataggcgctacagtccatctctgagagccagactctccatcaccggngaccgcctaccaatacgcaggtgactcctagagtcgaccaanagtcggcccctgcggacacagccanactactacncgcncacanatgtatactaaattaattaaagtaaaggttgggttagttagtaggtgttaggttgttgtttaagattgtcggtacggggacgtaacgggaactaag

SEQ ID NO: 337132 - DNA, 580 bp, Homo sapiens
  misc_feature: GZ8MTXP01AHAHV.44.29.C07.1.454.CMB.2.raw
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatgggagcgagttggtgggctggggtcccgtcacgccccccgaagggaaacggccctgggagtggcttagcactctatttagttgggatgatgataggcgactacagtcccatctctagaagngccagactcctccatacgaccggngaccgcctacaatacgcagggtcgacttccttaggagtcggaccaacacgtcggccccgtgaccggacacgacgacccatactacctacncggaccnccaacactantactacaaactttaattaaaagtaaaggtttgggtagttagtggtagaggttgggttcttttggattaacggttcggtagggggacctaaaggggctaaggg

SEQ ID NO: 337133 - DNA, 618 bp, Homo sapiens
  misc_feature: GZ8MTXP01CYUIW.44.29.C07.1.454.CMB.2.raw
  modified_base (222)..(222): a, c, t, g, unknown or other
  misc_feature (222)..(222): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (424)..(424): a, c, t, g, unknown or other
  misc_feature (424)..(424): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagacccctcacgctgacctgcaacctctctgggttctcactcaggngtgatggagcgattggtgggctggggtccgtcacgcccccgaggaaacggccctggagtggcttgcactcatttatggatgatgataggcgctacacgtccattctctagaagagccagtactctaccactaccgacccggngaccgccctacccaataccgcgtagggtanacttacccgttaggacggtcggacccaaanacgttccggcccctaggccggacacgacgtacccaacgtactaacctactcggacaccaacgactactacgtactaacctaaacttaatttaaagtaaaagggttggttaggttagtggtggttaacggtttgggttacttttaagggatttcggttcgggtacggggacccgtaaagggggaacccttaaggg

SEQ ID NO: 337134 - DNA, 515 bp, Homo sapiens
  misc_feature: GZ8MTXP01EX2HX.44.29.C07.1.454.CMB.2.raw
  modified_base (323)..(323): a, c, t, g, unknown or other
  misc_feature (323)..(323): n is a, c, g, or t
  modified_base (486)..(486): a, c, t, g, unknown or other
  misc_feature (486)..(486): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcagcccccaggaaaggccctcggagtggcttgcactcatttattgggagtgatgataggcgctacagtcatntctgaagagccagactctccactacaccggcgacgcctccaatacgcaggtgatccttagagtggaccaacaatcggcccctgcggacacacgccacactactactgcgcacacatgatacaactataataaagttggtggttagtgtgacgttgttcgtttnataatcgtggggacctaagggaacgtaag

SEQ ID NO: 337135 - DNA, 548 bp, Homo sapiens
  misc_feature: GZ8MTXP01CYD5P.44.29.C07.1.454.CMB.2.raw
  modified_base (541)..(541): a, c, t, g, unknown or other
  misc_feature (541)..(541): n is a, c, g, or t
tcagacagtatatacacgaccggtgctcgatttagagtgctacgaagggaaaggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctctgtacagcatcaccagcacacgccccagactcgtgtattttgaggtacaataacgccgccctcgacgggtcccgagtcggttctccgtggctccgaagtcgtacggaccaacgaccggtccctcccgtgacccgtctcgtcgggcctccgaggctgacgatgagtctagattatactgcaggctcgagtcggagctactatcgtatttgtcgtttcggcggtaacggccagtacttcggacctcgttaggttcacgcccgaggtcctccgtccccgttcggtccncgttccg

SEQ ID NO: 337136 - DNA, 576 bp, Homo sapiens
  misc_feature: GZ8MTXP01EJX6F.44.29.C07.1.454.CMB.2.raw
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggtctcactcaggagtgatggagcgattggtgggcgtggggtcccgtcgacggccccccgaaggaaacggccctgggagtggcttgcactctatttagtggatgatgataggcgctacagtcccatctacgtagaagacgacacgactctccaatacccgaaccggcgacgccctacaactacgcgagggtcatcctagngtcgacaaancgtcgcccctgacgacactacgaccaacgtatactaaccncgacacaactanatagtaactaactaaacgttaaattaaagtaaaggttggttagttagtggtagttacggttggttactttaagagttggtcgggacgggaaccgtaagggttaactaag

SEQ ID NO: 337137 - DNA, 443 bp, Homo sapiens
  misc_feature: GZ8MTXP01B12Q9.44.29.C07.1.454.CMB.2.raw
  modified_base (218)..(218): a, c, t, g, unknown or other
  misc_feature (218)..(218): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (430)..(430): a, c, t, g, unknown or other
  misc_feature (430)..(430): n is a, c, g, or t
  modified_base (437)..(443): a, c, t, g, unknown or other
  misc_feature (437)..(443): n is a, c, g, or t
tcagacagtatatacacgaccggtgctcgatttagagtgctacgaagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagngccggtgcgggagttcggggattgcatactactactacggtatggacgtctggggccaagggaccacggtcaccgtctcctcagcttccaccaagggcccatcggtcttccccctggcgccctgctcagganccacctntgggggcacacgcgccctgggctgcctggtcaaggctacttcctatatactgtctgagcgggctggcaaggcncgatagnnnnnnn

SEQ ID NO: 337138 - DNA, 648 bp, Homo sapiens
  misc_feature: GZ8MTXP01CVELM.44.29.C07.1.454.CMB.2.raw
  modified_base (354)..(354): a, c, t, g, unknown or other
  misc_feature (354)..(354): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgatggagcgattgtgggctgggtccgtcacgcccccaggaaggccctggagtggcttgcactctatttatgggatgatgataggcgctacagtccatctctagaagagccagactctccatacccaccgggngaccgcctacccgaaataccgcgtagggtacgtacttacccgttaaggacggtcgggaacccaaacgtacgtccggggtcccccctaggcccgggaaacaccgaacgaccccaaacgtaactaaccgttaacccgacggaccaccaacaactagtacgtaactaactaaaacgttaaattaaaggttaaaaggttgggttaaggtttaagtgggttaggttacggtttcggttcgtttaagtaacgttaacggttacgggtacgggggaaccgtaaacggggttaaccgtaagg

SEQ ID NO: 337139 - DNA, 600 bp, Homo sapiens
  misc_feature: GZ8MTXP01CA53J.44.29.C07.1.454.CMB.2.raw
  modified_base (432)..(432): a, c, t, g, unknown or other
  misc_feature (432)..(432): n is a, c, g, or t
  modified_base (488)..(488): a, c, t, g, unknown or other
  misc_feature (488)..(488): n is a, c, g, or t
  modified_base (556)..(556): a, c, t, g, unknown or other
  misc_feature (556)..(556): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacacgaccctcacgctgacctgccaacctctctggttctcactcgaggagtgagtggagcgtagttgggtgggtcgtcggggtccgtaccgacgccccccgaaggaaacggcccgtggagtggcttgcactctagtttagtggatgatgataggcgctacacgtccatctctagagagacccagactcaccataccgacggcgaccgcctaccaacgtaccgcgagtcacttaccgttaggacggtacggaccctaanacgttccggcccctcggaccggacaacgactacccaacgtaactacctagccgacnccaacacctatctaataacctaattaattaaagtaaaggttggtagttagtggtagttaggttggttntttgacgttggtacggtcggggaccgtaagggttaattaaccgg

SEQ ID NO: 337140 - DNA, 571 bp, Homo sapiens
  misc_feature: GZ8MTXP01BET47.44.29.C07.1.454.CMB.2.raw
  modified_base (323)..(323): a, c, t, g, unknown or other
  misc_feature (323)..(323): n is a, c, g, or t
  modified_base (398)..(398): a, c, t, g, unknown or other
  misc_feature (398)..(398): n is a, c, g, or t
  modified_base (469)..(469): a, c, t, g, unknown or other
  misc_feature (469)..(469): n is a, c, g, or t
  modified_base (538)..(538): a, c, t, g, unknown or other
  misc_feature (538)..(538): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgagttggtgggcgtggggtcccgtcgacgccccccgaggaacggccctggagtggcttgcactctatttagtggatgatgataggcgctacngtccatctctagaagagccacgactctaccactaccgaccgggaacgaccgaccctaccaactacgacgaggtanactccgttaaggacggtcggaccaacgacgtcggcccctggaccggacaccacgtacccacgactactacncgccacactacatacgaatacaaacttaattaaagtaaaggttggtagttagtgtgagttgttatttgnttaacgtcggacggggttacaagggaacgtaag

SEQ ID NO: 337141 - DNA, 684 bp, Homo sapiens
  misc_feature: GZ8MTXP01A94JC.44.29.C07.1.454.CMB.2.raw
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgatggagcgattggtgggctggggtcccgtcacggccccccgaagggaaacggcccgtggagtggcttgcactctagtttagtgggatgatgataggcgctacagtccatctctagaagngccagactcgtccactaccgaacccgggngaccgccctaccaaacgtaccgacgtaagggtcgaacttcccgttaaggacggtacggacccaaacgtacgttccgggccccctaggacccggaacaaccgaacgaccccaacgtaacttaaccgtaaccgtcgacccgacaaccaactaacgttacgaaacttaaccctaaaactttaaagtttaaaaggttaaaaagggttggggtttaagttaagttgggttaccgggttaaggttggggttaccttttaaggaagtttaacggtaccgggttacgggggaacccgtaaagggggttaacccttaaaggg

SEQ ID NO: 337142 - DNA, 521 bp, Homo sapiens
  misc_feature: GZ8MTXP01EEP32.44.29.C07.1.454.CMB.2.raw
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatgggagcgattggtggggctggggtcccgtcagccccccaggaaaggccctggagtggcttgcactcatttatgggatgatgataggcgctacagttccatctctgaagagccagactcnccatccaccggngaccgcctaccaatacgcaggtnatccttagagtgccaanatcggcccctgcgacncagccagatactacngccncacacaatgaatcctaaatattaaataaagttggtgttatgtggacgttgggcttttgagtnttcggngggggaccaaggggcctaagg

SEQ ID NO: 337143 - DNA, 553 bp, Homo sapiens
  misc_feature: GZ8MTXP01DND9U.44.29.C07.1.454.CMB.2.raw
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (514)..(514): a, c, t, g, unknown or other
  misc_feature (514)..(514): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttcncactcaggagtgatggagcgattggtgggttgggtccgtcacgcccccgaggaaacggccctggagtggcttgcactcatttatgggatgatgataggcnctacagtcccatctctagaagngcacgactctccatcaaccggagcgcctccaaatacgcaggtgactccttagacgtggaccaacgacgtcggccccctggaccggacacacgacccaacacgttactacctgccgacacacagtagactactaaactattaaataaaaggttggttaggttattggtagtacgttaggttnttagaatagtcggtacgggacgaagggaacgttaagtcg

SEQ ID NO: 337144 - DNA, 582 bp, Homo sapiens
  misc_feature: GZ8MTXP01B7OAC.44.29.C07.1.454.CMB.2.raw
  modified_base (480)..(480): a, c, t, g, unknown or other
  misc_feature (480)..(480): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgagttggtgggctgggtcccgtcacgccccccgagggaaacggccctggagtggctgcactctattagttggagtgagtgagtagcgctacacgtcgactctctagagagccagacgtctccactacaccggaacgaccgacctacccaacgtacgacgagtagtactacgtagacgtcgaccaacgaacgtccggcccgtcgccgaccaacacgacccacgtaactactaccacgcgaccacacaatntaactactaaacctaattaaataaaggttgggttagttagtaggtgttaggttgttacgtttgtagttgtcgggtgggacccggtaaggttaacgtaaccgg

SEQ ID NO: 337145 - DNA, 580 bp, Homo sapiens
  misc_feature: GZ8MTXP01CQXGN.44.29.C07.1.454.CMB.2.raw
  modified_base (345)..(345): a, c, t, g, unknown or other
  misc_feature (345)..(345): n is a, c, g, or t
  modified_base (478)..(478): a, c, t, g, unknown or other
  misc_feature (478)..(478): n is a, c, g, or t
  modified_base (489)..(489): a, c, t, g, unknown or other
  misc_feature (489)..(489): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagacccctcacgctgacctgcaacctctctgggttctcactcaggagtgatggagcgtagttggtggggctggggtcccgtcacgccccccgaggaacggcccgtggagtggcttgcactctagtttattgggatgatgagtaggcgctacagtccatctactagaagngaccagactctaccactaccgaaccggaacgaccgtccctaccaataccgcgtaggtgtactaccgttaaggacggtcggaaccaagtacgtccggcccctggaccgacacgacgacccaacgtactactacncgcacacacangtaactactaaattattaaagtaaaggttggttagttagtggtgttagttcgttntttaagntaagtcggtagggacctaagggaactaag

SEQ ID NO: 337146 - DNA, 612 bp, Homo sapiens
  misc_feature: GZ8MTXP01BVXDL.44.29.C07.1.454.CMB.2.raw
  modified_base (430)..(430): a, c, t, g, unknown or other
  misc_feature (430)..(430): n is a, c, g, or t
  modified_base (490)..(490): a, c, t, g, unknown or other
  misc_feature (490)..(490): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgagtggagcgtagttggtgggcgtggggtcccgtcgacgccccccgaggaaacggcccgtggagtggcttgctactctatttagttgggatgatgataggcgctacagtccatctcgtagaagagaccacgtactctacccacgtaacccgaacccgggaacgacccgtaccctaccaacgtaccgcgtaggtctacgttccgtaggngtacggacccaacgacgtccgggcccctggaccgacaccacgacccaacgtactactacncgcacacacatgtaactactaaacttaagtaaagttaaaggttggttagttgttaggtgttaggttgttcgtttaagattaacggtcgggacggggttacgtaaacgggttaacgttaacgg

SEQ ID NO: 337147 - DNA, 732 bp, Homo sapiens
  misc_feature: GZ8MTXP01E0CAD.44.29.C07.1.454.CMB.2.raw
tcagacagtatatacacgaccggtgctcgatttagagtgctacgaagggaaagggggactcctgtcgccccaccatggacacactttgctccacgctcctgctgctgaccatcccttcatgggtcttgtcccagatcaccttgaaggagtctggtcctacgctggtgaacgcccacacagacccctcacgctgacctgcaacctctcgtggttctcactcagggagtgagtggagcgtagttggtggggcgttcggggtccgtcgaccgacccccgaaggaacggccctggagtcggtcgttgccactctagtttagttgggtatagtaagtggaagtacgggaccgtacgtaaccgtacgttacccaacgttctacgtaggaaagacggaccacgactcctaccacgtaaccgacccggaacgacccgaccctacccgaagtacgacgaggtcgtaacgttacccgttaggacggtacggaccccaaacgtccgtccgggacccccgtaggaccggaccaaccgacgacccaacgtactaaccgtaccgagacccgaacctaaacgaactaagtaacgtaaactaacccttaaaacgttaaagtttaaaggttaaaagggtttgggttaagggtttaagttaggggtaggttagggtttcggttacgttttaaggaaagtttaacggttacggggacgggggaaacccgtaaagggggaaccttaaccggg

SEQ ID NO: 337148 - DNA, 597 bp, Homo sapiens
  misc_feature: GZ8MTXP01C53A8.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtggggctggggtccgtcacgccccccgaggaaacggccctggagtggcttgcactcatttattgggatgatgataggcgctacagtccatctctgaagagccagactctccatccgaaccgggcgaccgccctacccaagtacgcagggtgacttccgttaaggaggtacgggacccaaacgacgtccgggccccctggacccgggaacacgacgacccaacgtaacttacctacctcgccgaccaacaccatcgtaattaccaaactttaaattaaagttaaaaggttggtttaggttagttggtaggttaggttggttcttttgattcgtcggtaggggacctaaggggaacctaagg

SEQ ID NO: 337149 - DNA, 620 bp, Homo sapiens
  misc_feature: GZ8MTXP01C81ZG.44.29.C07.1.454.CMB.2.raw
  modified_base (317)..(317): a, c, t, g, unknown or other
  misc_feature (317)..(317): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacttctctgggttctcactcaggagtgatggagcgattggtgggctggggtccgtcacgccccccgaaggaaacggcccgtggagtggcttgcactctatttagtggatgatgataggcnctacagtccatctctagaagagaccagactctccactacaccggcaccgcctaccaactacgcgtaggtacgattccgttaggacgtcggaccctaacgacgtcgggacccctggaccggacaacgacgacccaacgtaacttaaccgttaacgcggaccgaccaacaacgtaacttagaacttaaccctaaactttaattaaaggttaaaaggttgggtttaagttaacgttggtagttaggtttggttacttttaagaagttaacgtcgggtacggggaccctaaaggggttaacctaagg

SEQ ID NO: 337150 - DNA, 606 bp, Homo sapiens
  misc_feature: GZ8MTXP01BIVLL.44.29.C07.1.454.CMB.2.raw
  modified_base (336)..(336): a, c, t, g, unknown or other
  misc_feature (336)..(336): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgatggagcgattggtgggctggggtccgtcgacgcccccgaggaacggcccgtggagtggcttgcactctatttagtggatgatgataggcgctacgagtccatctgtagaagngacccagtacctcgtccacgtaccgacccggaacgaccgacccttaccaacgtacgcgtagggtacgtacttccgttagacggtccggacccaacgacgtccgggcccccgtggacccggacaaccgtacgaccctaacgtaacttaccgtactcgggaccaccaacacatcgataactaaactaattaaagtaaacggttggttaggttagtggtagttagttcggttatttgacgtgtcgggacgggttacaaggggttaactaacgg

SEQ ID NO: 337151 - DNA, 646 bp, Homo sapiens
  misc_feature: GZ8MTXP01EFUTN.44.29.C07.1.454.CMB.2.raw
  modified_base (327)..(327): a, c, t, g, unknown or other
  misc_feature (327)..(327): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtccccagatcaccttgaaggagtctggtcctacgctggtgaagcccacacagacccctcacgctgacctgcaacctctctggttctcactcaggagtgatggagcgattggtgggcgtcgggtcccgtcgacgccccccgaggaacggccctgggagtggcttgcactctagtttagtgggatgatgagtaggcgctacncgtccatctctagaagagccagtacctctaccactacccgaccgaaggacctaccctacaacgtacgcgagggttcgaacttccgttaaaggacgtcggaacccaaacgtacgttccggacccccgtaggacccgggaacaaccgaacgtccccaaacgtaactaccgttaacgtcggaaccaccaaccttacaaactcgtaactaacgtaaactttaaagttaaaggttaaagggttggttagggttagtaggtaggttggttgttacgttaagtagtaacggtacgggtacgggaacgtaacgggttaacgtaacgg

SEQ ID NO: 337152 - DNA, 618 bp, Homo sapiens
  misc_feature: GZ8MTXP01AF7R7.44.29.C07.1.454.CMB.2.raw
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctgatgaagcccacacacgaccctcacgctgacctgcaacctctctgggttctcactcaggagtgagtggagcgtagttggtgggcgtgggtcccgtcgaccgacccccgaagggaacgcccgnggagtggtcttgcactctatttagtggatgatgatggcnctacacgtccatctctagagacgcagcctctacccaaactcccgaaccggagacccgaccctaccgaactacgacgaggtcgtactaccgttagacggtacgaccaaacncgtccggccccaggaccgacacgaccgacctactaactacgtaacgngacccnccaaacacgatactaaactaaccttaaagttaaagtttaaaagttaaagggtttcggttaggtttagtgggttacggttggttcgttaagtttagaacgttaggtaccgggttacgggtaaccgaagggtaa

SEQ ID NO: 337153 - DNA, 639 bp, Homo sapiens
  misc_feature: GZ8MTXP01C9YGH.44.29.C07.1.454.CMB.2.raw
  modified_base (518)..(518): a, c, t, g, unknown or other
  misc_feature (518)..(518): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacacgaccctcacgctgacctgacctacctctcgtgggttctcactcgaggagtgagtggagcgtagttgggtcgggcgtcggggtcccgtaccgacggacccccgaagggaaccggcccgtgggagtggcttcgctactctagtttagtggtatgtatgagtaggcgactacacgttccattctctagacgagaccacgtactctaccacgtaacccgaccggaacgacccgaccctaacccgtaacgtaccgacgtaggtactaacttacgtaaggacgtacggaccctaaacgcgtccggccccgtaggaccgacacgtacgacccaggtactacgtacncgacacacacagtacactaacctaaattaaagttaaagtaaaggttggttagttgtaggtagttaggttggttactttaaggattcggcgggtaagggaccgtaagggttaacgtaacggg

SEQ ID NO: 337154 - DNA, 747 bp, Homo sapiens
  misc_feature: GZ8MTXP01D4AWI.44.29.C07.1.454.CMB.2.raw
  modified_base (224)..(224): a, c, t, g, unknown or other
  misc_feature (224)..(224): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacacgaccctcacgctgacctgccaacctctctgggttctcactcgaggngtgagtgggagcgtagttggtggggcgtcggggtcccgtcgacgcccccgaaggaaacggcccgtggagtggcttgcactctatttagttggatgatggagtaggcgactacacgtccattcctactaggaaagacgaccacgtaccttccgtacctaacgtacccgaaccgggaaccgacccgtaccctaacccgaaactaccggacgaggggttactacgttacccgttaggacgtcgaacccgtaaacgacgtcccgggaccccgtagggacccgaacccgaaccgaccgtaccccaaaccgggtaactttaaacccgtaccgtacggacccgaccaaacctaaccgtataacgtaaaccttaaccctaaaacgtttaaagttaaaaagtttaaaagggtttgggtttagggtttaaagtgggtttaaggaggggtttccggttaagttttaagggtaactttaacgggttcgggtaccggggggttaaaccgtaaacgggggttaaccttaaacggggg

SEQ ID NO: 337155 - DNA, 618 bp, Homo sapiens
  misc_feature: GZ8MTXP01DA1R5.44.29.C07.1.454.CMB.2.raw
  modified_base (394)..(394): a, c, t, g, unknown or other
  misc_feature (394)..(394): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcacctctctggttctcactcaggagtgatggagcgagttggtgggcgtggggtcccgtcacggccccccgaggaacggccctggagtcggcttgctactctatttagtggatgatgataggcgctacagtccatctctagagagccagactctccagtaccgaccggtgaccgccctacccgaataccgacgtaggtanacttccgttaaggacggtacggaccaaacgacgtaccggccccgtaggaccggaaccacaacgaccccaagtaaccttacgtaccgcggccaccaacgactaatagaacctactaaactttaagttaaataaaaggtttggttagggttatagggttgttaagggttgttgtttaagaattggttaccggtagggggaacccgtaaagggttaacgttaacggg

SEQ ID NO: 337156 - DNA, 564 bp, Homo sapiens
  misc_feature: GZ8MTXP01DH4O8.44.29.C07.1.454.CMB.2.raw
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (462)..(462): a, c, t, g, unknown or other
  misc_feature (462)..(462): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgatggagcgattggtgggctgggtccgtcacgcccccaggaaacggccctggagtggcttgcactctatttatgggatgatgataggngctacagtccatctctagagagccagactctccataccgacccgngaccgccctaccaataccgacgaggtcgtacttccgttaaggagtacggacccaaacgacttaccgggcccctggccggaacacacgcccaacgactaaccgttacncgccgaccacacatcgaatacaaactaattaaagtaaagttgggtagttagtgtgttaggttgttctttaagatcgtcgaggggacctaaggggaactaagg

SEQ ID NO: 337157 - DNA, 660 bp, Homo sapiens
  misc_feature: GZ8MTXP01ELC37.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacagaccctcacgctgacctgccaacctctctgggttctcactcaggagtgatggagcgtagttggtgggtctggggtcccgtcgacgcccccgaaggaacggcccgtggagtggcttgctactctatttagtggatgatgagtaggcgctacacgtccatctacgtagaagtacgaccacgtactccgtacccacgtacccgaaccgggaacgacccgtaccctaccgtaaacgtaccggtacgtagggttactacgttacccgttaaggtacgtacggaaccgaacgtaacgtccggccccgtagacccggacaacgacgaccaacgtactaaccgtaccgtacggaccacaacgaccgtatacgtaactactaaacctttaagttaaagttaaaggttgggttaaggttagtggttagttaggttggttacgttaagtagttcgtaccgggcggggttaactaacggggttaacttaacggg

SEQ ID NO: 337158 - DNA, 751 bp, Homo sapiens
  misc_feature: GZ8MTXP01EAKWK.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagacccctcacgctgacctgcaacctctctggttctcactcgaggagtgagtggagcgtagttggtgggtcgtcggggtccgtccgacgcccccgaagggaaacggcccgtgggagtggcttgctactctatttagtggatgatgagtaggcgactacgacgtccattctactagaagacgccaacgtactcctaccacgtacccgaacccgggaacgaacccgtacccctaacccgaaacgtaccggacgtaaggggttactaaccgtttacccgtttaagggacggtaccgggaaccctaaacgtaccggttccgggacccccgtagggaacccggaaccaaccgacgaccccaaacgtaacttaaccgtaacgtcgaccgaccaaaccgtactaaagtcgtaaaccttaaccgtaaaacttttaaagttaaaaacggtttaaaaaggggttcgggggttttaaggttttaaagttggggttaagggttaacggggtttggttaccgtttttaaggaacgtttaacgggttacgggtacgggggaacccgggtaaagggttaacgttaaacgg

SEQ ID NO: 337159 - DNA, 556 bp, Homo sapiens
  misc_feature: GZ8MTXP01EEU63.44.29.C07.1.454.CMB.2.raw
tcagacagtatatacacgaccggtgctcgatttagagtgctacgaagggaaagggggggtctcaggaggcagcgctctcaggacgtcaccaccatggcctgggctctgctccctcctcaccctcctcactcaggacacagggtcctgggcccagtctgccctgactcagcctccctccgcgtccgggtctgtcggtcagtcagtcaccatctcctgcactggaaccagcaattcattggtaatcatgactatgtctctggtaccagcatcaccagcacagcccccagactcgtgtacttttgagtcaataagcgcccctgaggggtcccgatcggtctcctggctccaagtctacggacaacgacggccctccgtcgacccgtctcgtcgggctccgaggctgacgatgagctgattatactgcaggggctacgagtacggagcctacctagtgtagttttgccgttttcgggacggtaagggaccgagtacgttcgaccgtcttaacgggttcacgcccgaaggccttcgcccccgttggtccgttaacttcccg

SEQ ID NO: 337160 - DNA, 819 bp, Homo sapiens
  misc_feature: GZ8MTXP01BZ69Q.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacagaccctcacgctgacctgcaacctctctggttctcactcaggagtgagtggagcgtagttggtcgggtcgtcggggtcccgtcgacgaccccccgaagggaaacggcccgtggagtggcttgctactctatttagtggatgatgagtacggacgctacacgtctatctacgtagaagacgaccacgtactccgtaccacgtaacccgaacccggaacgacccgtaccctaccgaaacgtaccgacgtaacgggtactaacgtttccgttaaaggacgggttaccggaaccctaaacggtaaccggttccccgggtacccccgtagggaccccggaaaccaacccggaacgtaccccccaaaggtaaaccctttaacccgttaaccgtaccgggacccgtaaccctaaaccgaaacccgttaagttaacgttaaaacccttaaaacccttaaaacgttttaaaacggtttaaaaacgggtttaaaaaggggtttgggggtttttaaagggttaacgtttaaggggtttacggggttaaagggttttcgggttaaccgtttttaagggtaacgtttaaccgggtttaccgggggaacgggggttaaaccccggtaaaagggggttaaccgtttaaacccgggg

SEQ ID NO: 337161 - DNA, 717 bp, Homo sapiens
  misc_feature: GZ8MTXP01AMS1B.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacagacccctcacgctgacctgccaacctctctggttctcactcaggagtgagtggagcgtagttggtggggcttcggggtcccgtcgaccgccccccgaaggaaacggccctggagtggcttgcactctatttagtggatgatgagtaggctactacacgtccattccttagtagaaagacgaccccgaacgtacctcccgtaccaacgtaacccgaacccgggaacgaccccgtcccttaccgaaacgttaccggacggtaagggttacgtaaccgtttacccggttaaggacggttaccgggacccaaaccgtacggttacccggcccccgtaggaccccggaaccaaccgaccggtaccccaaacgtactaacccgttacgccggacgaccaactaccgtaaagttacgaacttaacctaaacttaaagttaaagtaaaaggttggggttaacgttaagtcgggttagttacggttgggttacgtttaagtacgttaacggtcgggtacgggggaccgtaaaacgggttgttaaccgg

SEQ ID NO: 337162 - DNA, 639 bp, Homo sapiens
  misc_feature: GZ8MTXP01COQ4R.44.29.C07.1.454.CMB.2.raw
  modified_base (359)..(359): a, c, t, g, unknown or other
  misc_feature (359)..(359): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgagtggagcgtagttgtgggctggggtcccgtcacgcccccgaggaaacggcccctggagtggcttgcactcatttattggatgatgataggcgctacagtccatctctgagagccagactctccataccaccggngaccgtccctaccaatacgacgaggtcgtagttccgtaaggacggttacggacccaaacgacgttacccgggcccccttagggaccgaaccgaaccgaccgggaccccaaacgttaactaaacccgtttaccgaccggacccggacccaaccacgtaacgtacgtaacttactaaactttaattaaagttaaaacggttgggtttagttagtaggtggttagttgggttacttttaagactttgcggttaggggacccgtaaggggttaacgttaacggg

SEQ ID NO: 337163 - DNA, 618 bp, Homo sapiens
  misc_feature: GZ8MTXP01CU66O.44.29.C07.1.454.CMB.2.raw
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (595)..(595): a, c, t, g, unknown or other
  misc_feature (595)..(595): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacacgaccctcacgctgacctgcacctctctgggttctcactcgaggagtgagtggagcgtagttggtgggtcgtcgggtcccgtacgaccggacccccgaaggaaaccggcccgtgggagtggtctgcacttntatttagtggatgatgagtagctacgactacgtacatctacgtagaagacgaccacgtactctacctacaaccgaacccggngacccgcccttaaaccgaaactaccggacgtacgggtactacttaccggtagtaacgggccgaaccaaagtaccgtccggacccgacgggaccgacacgacctaccacgtactacctacgacgaccacaccanatanactaataaacgttaattaagtaaagttggtttacgttgtagtgaggttgttatttgaattgtcgggngggaaccgtaaggaacgtaacgg

SEQ ID NO: 337164 - DNA, 562 bp, Homo sapiens
  misc_feature: GZ8MTXP01ANI26.44.29.C07.1.454.CMB.2.raw
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtgggctggggtcctcacgccccccgaggaacggccctggagtggcttgcactctatttatgggatgatgatggcnctacagtccatctcgtagaganccagactctccatacgaccgngccgcctaccaagtacgcagggtcataccgttagacgtaggacccaaancgtcggcccctgccggacacacgacacatcctacgngcccgacaccanagtctatacctaaacgttaattaaagtaaagggttgggtacgtttagtaggttagaggttggttattttggattaacggtcggtacggggaccgtaaggggaactaaggg

SEQ ID NO: 337165 - DNA, 757 bp, Homo sapiens
  misc_feature: GZ8MTXP01CF72P.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacacgaccctcacgctgacctgcaacctctctggttctcactcaggagtgagtggagcgtagttggtgggcgttcggggtcccgtcaccggcccccgaaggaacggcccgtggagtggcttgcactctattagtggatgatgagtaggcgtctacagtccactctacgtagaagagacccacgtactctcccaacgtacccgaacccgggaacgacccgtacccgttaacccaaacgtaccggaccgtaagggtacgtaaccgttacccgtttaacgggaacggttaccgggaacccctaaacgtaaccgttccccgggcccccgtagggaccccggaaccaacccggaccgacccctaaacgtaaccgttaacctacccgtacggacccaccgaaaccgaaccctaagttaacgaaacctttaaacccgtaaaactttaaagtttaaaaccggtaaaaggtttcggggtttaaacggtttagtagggttaggttaaacgggtttggttaccgttttaaggaacttaacggttaaccgggacgggggttaaaccgtaaaagggggttaaccttaaaccgggg

SEQ ID NO: 337166 - DNA, 769 bp, Homo sapiens
  misc_feature: GZ8MTXP01BXEJ6.44.29.C07.1.454.CMB.2.raw
  modified_base (331)..(331): a, c, t, g, unknown or other
  misc_feature (331)..(331): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacagaccctcacgctgacctgccaacctctcgtggttctcactcgaggagtgagtggagcgtagttggtcgggtcgtcggggtcccgtcgaccgccccgaagggaacggcccgtggagtggtcttgcactctagtttagtggatgatgagtaggcnctacagtccatctatagagacgccactacgtcctaccacgtaacccgaaccgggaacgacccgtaccctaacccgtaaacgtaccggtacgtaacgggtactacgttacccgttaaggaccggttaccggaaacccctaaaagtcccgggttacccgggacccccgttacgggaacccgggaaccctaaaccgaccggacccctaaacctaacgttaacccgtaaccgtcggacccgtaaccaacctaacgtaacgttagtaaaccttaaacgttaaaacgtttaaagtttaaaaggtttaaaaggggttcggggttttaaaggtttaacgttaggggttaacggttaacgggttttgggttaccgttttaaggtagttaaccgggttacgggtaccgggggttaaacccgtaaaagggggttaatttaaacccgggg

SEQ ID NO: 337167 - DNA, 520 bp, Homo sapiens
  misc_feature: GZ8MTXP01E1LOJ.44.29.C07.1.454.CMB.2.raw
  modified_base (184)..(184): a, c, t, g, unknown or other
  misc_feature (184)..(184): n is a, c, g, or t
  modified_base (230)..(230): a, c, t, g, unknown or other
  misc_feature (230)..(230): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctnacgctgacctgcaacctctctgggttctcactcaggagtgatggancgattggtgggctggggtccctcacgcccccaggaagccctggagtggcttgcactcatttatgggatgatgataggcgctacagtccatctctgaagngcccagactctcatccgaccggnaccgcctaccgaatacgcagggtnactcctagngtgaccaatntcgggtccctggccgaanacacgacactactacnctcgcacacacatnatactaactaataagtaagttaggtagttagtgtgttagttgttgttntagtaagtcgtggacgtaacggaagtaag

SEQ ID NO: 337168 - DNA, 551 bp, Homo sapiens
  misc_feature: GZ8MTXP01DXE2Z.44.29.C07.1.454.CMB.2.raw
  modified_base (500)..(500): a, c, t, g, unknown or other
  misc_feature (500)..(500): n is a, c, g, or t
  modified_base (530)..(530): a, c, t, g, unknown or other
  misc_feature (530)..(530): n is a, c, g, or t
tcagacagtatatacacgaccggtgctcgatttagagtgctacgaagggaaaggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtcctcagcccccaggaaaggccctggagtggcttgcactctattattggatgatgataggcgctacagtccatctctagaagacgcagactctcccatcccaccggcgacgccctaccaatacgctaaggtcgacttccttaggacgtcggaccaaacgcgtcgggccccctagggccggaacacaacgtcccaacgaactaccgtaactcgaccgcaacacaatgatacaactattaaataaagttggtaggttntagtcgagttggttctttgaattcgttcgnggggttaccaagggaactaag

SEQ ID NO: 337169 - DNA, 631 bp, Homo sapiens
  misc_feature: GZ8MTXP01EFQLK.44.29.C07.1.454.CMB.2.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (461)..(461): a, c, t, g, unknown or other
  misc_feature (461)..(461): n is a, c, g, or t
  modified_base (557)..(557): a, c, t, g, unknown or other
  misc_feature (557)..(557): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacacgaccctcacgctgacctgcacctctctggtctcactcaggatgagtggagtcgtagttggtcggggcgtcggggtcccgtacgacgccccccgaagggaaacggcccgtgggagtcggcttggctactctatttagtgggatgatgagtaggacnctacacgtccnttctcagaagacgccacgactctccgataccgaccggcgaccgcctacacgtacgcgaggtacgtactcgtaagcggtacgaccaagccgtccggccctgaccgaccaacgtaccncctaacgacttaacctccgtacggacccgacctaccaatacgttacaactaacctaaattaagttaaagtttaaaaggttgggtttaggtttaagngggtttgaagggtttcggttgtttaagcgttaacggtcggtacgggggacgtaaacggggttaaccttaagggg

SEQ ID NO: 337170 - DNA, 507 bp, Homo sapiens
  misc_feature: GZ8MTXP02HW7OC.44.29.C07.1.454.CMB.2.raw
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
  modified_base (475)..(475): a, c, t, g, unknown or other
  misc_feature (475)..(475): n is a, c, g, or t
tcagacagtatatacacgaccggtgctcgatttagagtgctacgaagggaaaggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagcccccaggaacggccctggagtggcttgcactcatttatgggatgatgataggcgctacagtccatctctgaagagccagacctctccatccaccggngaccgcctaccaactacgcaggtnatcctagagtggccaanancggccctgccgacacagccanatactactgccgcacacagtnatacaactattaataaaagtggtagttatgtgacgtggtnttgattagtcgtaggggaccaaggggactaag

SEQ ID NO: 337171 - DNA, 515 bp, Homo sapiens
  misc_feature: GZ8MTXP02JNWY5.44.29.C07.1.454.CMB.2.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcagcccccaggaaaggccctggagtggcttgcactcatttatgggatgatgataggcgctacagtccatctctgaagngccagactctccatcaccggnaccgcctccaatacgcaggtnatccttagagtggccaacatcggccccctggcggacacagccaacactactactgccgcacacatgatacaactaattaataaaagtaggttaggttagttagtgtagtggtgttgtatagtcgtgggtacgaacggacgtaag

SEQ ID NO: 337172 - DNA, 536 bp, Homo sapiens
  misc_feature: GZ8MTXP02G50LC.44.29.C07.1.454.CMB.2.raw
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtggctgggtccgtcagcccccaggaacggccctggagtggcttgcactcatttatgggatgatgataggcgctacagtccatctctgaagngccagactctccatcaccggngaccgcctccaatacgcaggtnaacttccttagagtcggacccaacgacgtcgggccccctggaccggacacgagcccaacatacctactgcgccacacatgactacaaactattaaataaaaggtggttaggttatgtgtacgttggtctttaagattacgtcgtaggggacctaaggggactaagg

SEQ ID NO: 337173 - DNA, 438 bp, Homo sapiens
  misc_feature: GZ8MTXP02JSIZX.44.29.C07.1.454.CMB.2.raw
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (426)..(438): a, c, t, g, unknown or other
  misc_feature (426)..(438): n is a, c, g, or t
tcagacagtatatacacgaccggtgctcgatttagagtgctacgaagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagctccaccaggccatcgtctcccctgcnccngctcagcnccactcgtggggcacgngcggcctgggctcgcctggtcaggtactacttctatatactgtctgacggcggctggcaggcgcatagnnnnnnnnnnnnn

SEQ ID NO: 337174 - DNA, 542 bp, Homo sapiens
  misc_feature: GZ8MTXP02J2D38.44.29.C07.1.454.CMB.2.raw
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcacgcccccaggaaacggccctggagtggcttgcactcatttattgggatgatgataggcgctacagtccatctctgaagagccagactctccatcaccggngacgccctccaatacgcaggtgatccttagagtggccaaacngtcggccccctgccgggacacacgccacatactactgccgcacacatcgatacaaacttaattaagtaaaaggtggttacggttaatggtagacggttggtacttttggaattacgtcggttaggggacctaaagggggactaaagg

SEQ ID NO: 337175 - DNA, 549 bp, Homo sapiens
  misc_feature: GZ8MTXP02I757S.44.29.C07.1.454.CMB.2.raw
  modified_base (226)..(226): a, c, t, g, unknown or other
  misc_feature (226)..(226): n is a, c, g, or t
tcagacagtatatacacgaccggtgctcgatttagagtgctacgaagggaaagggggggtctcaggaggcagcgctctcaggacgtcaccaccatggcctgggctctgctcctcctcaccctcctcactcaggacacagggtcctgggcccagtctgccctgactcagcctccctccgcgtccggtctgtcggtcagtcagtcaccatctcctgcactggaacccngcaatttcattggtaatcatgactatgtctctgtaccagcatcacccagcacacgcccccagactcgtgtattttgagtcaataacgccgcccctcgacggggtcccgagtcggttctccgtggctcaagtctggcacgcgccctcctcgacctctcgtgggcctccgaggctgacgatgaggctgtattagtactgcagctccgatgggagcacgtatgtatttgtcgtttcggcggtacggtaccaggtccgtagacccgttccgtacggtccaacgcccgtaaaggccgttccggcccccgtacggtccctactttcccg

SEQ ID NO: 337176 - DNA, 565 bp, Homo sapiens
  misc_feature: GZ8MTXP02I2AUD.44.29.C07.1.454.CMB.2.raw
  modified_base (356)..(356): a, c, t, g, unknown or other
  misc_feature (356)..(356): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcacgcccccaggaacggccctggagtggcttgcactctatttagtgggatgatgagtaggcgctacagtccatctctgaagagccagactctccatccgaccggngaccgccctaccaactaccgcagggtcacttccgttagacgtcggacccaaagtacgtccgggcccctggaccggacacgacgacccaacacttactaccgtgaccgacacacgatacgactacaaacttaattaaagtaaaaggttggttagttagtgtagagttggtactttaagattacgtcggtgggaccgaaggggactaacgg

SEQ ID NO: 337177 - DNA, 521 bp, Homo sapiens
  misc_feature: GZ8MTXP02I01TV.44.29.C07.1.454.CMB.2.raw
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcagcccccaggaaaggccctggagtggcttgcactcatttatgggatgatgataggcgctacagtccatctctgaagngccagactctccatccaccggngaccgcctaccaatacgcaggtnactccttagagtcggaccaacgacgtcggccccctggaccggacacgacgcccacactactactgcgcacacatgatacaacttattaagtaaaagtggtagttatgtagaggtgtcttgatagtcgtagggaccaagggactaagg

SEQ ID NO: 337178 - DNA, 546 bp, Homo sapiens
  misc_feature: GZ8MTXP02HNASO.44.29.C07.1.454.CMB.2.raw
  modified_base (454)..(454): a, c, t, g, unknown or other
  misc_feature (454)..(454): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcacgcccccaggaaggccctggagtggcttgcactctatttattgggatgatgataggcgctacagtccatctctagaagagccagactctccatccaccggcgaccgcctaccaactacgcgaggtgaacttcccttaaggcgtacggacccaaagtacgtcggccccctggccggacacgacgacccaacacttacctaccngaccacacacatgatacaaactattaagtaaaagttggtagttatgtagacgttggtctttgatacgtcggtagggaccgaagggactaagg

SEQ ID NO: 337179 - DNA, 622 bp, Homo sapiens
  misc_feature: GZ8MTXP02HN915.44.29.C07.1.454.CMB.2.raw
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagacagtatatacacgaccggtgctcgatttagagtgctacgaagggaaagggggggtctcaggaggcagcgctctcaggacgtcaccaccatggcctgggctctgctcctcctcaccctcctcactcaggacacagggtcctgggcccagtctgccctgactcagcctccctccgcgtcccgggtctgtcggtcagtcagtcaccatcctcctgcactggaaaccagctaatttcattggtaatcatgactatgtctctggtaccagcatcacccaggcacacgcccccagactcgtntattttgagtanaatacgccgtcccgtcgacggggtcccgtagtccggttctccgtcggtctctagtctcggacacgccggcctcccgtcgtacccgtcgtccgtcgggccctccgacggctcgacgtagtcggaggtctagtaatttatacgttgactacgtccgttaccgagcgggacggacctaccgttatacggttatttcgtcgttttcgggcgggtacgggtaccgacggtaccgtacggtacccgttaccgttacggtaccgacggaaccccgaacggtccgtcccggtacccccgtcggtcctaccgttcccg

SEQ ID NO: 337180 - DNA, 618 bp, Homo sapiens
  misc_feature: GZ8MTXP02GFG7H.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgccaacctctctgggttctcactcaggagtgatggagcgattggtgggcgtggggtccgtcgacgcccccgagggaaacggcccgtgggagtggcttgcactctatttagtgggatgatgataggcgctacagtccatctctagaagagccagacctctaccactaccgaaccggcgaccgccctacccaagtaccgacgagggtcactccgttagcggtacgacccaaacgtcgtccggccccgtggaccggaccaccgacgacccaacactactacctcggaccaccaacacagtacgaactactaaacttaattaaacgtaaaagggttggtttaaggttagttacggttaggtaggttggttacgtttaaggtacttacggttaccgggtagggggtacccgaaaaggggtactaaacgg

SEQ ID NO: 337181 - DNA, 574 bp, Homo sapiens
  misc_feature: GZ8MTXP02GBOUU.44.29.C07.1.454.CMB.2.raw
  modified_base (355)..(355): a, c, t, g, unknown or other
  misc_feature (355)..(355): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcacgcccccaggaaacggccctggagtggcttgcactctatttatgggatgatgataggcgctacagtccatctctgaagagccagacctctccatccaccggngaccgcctccaactaccgcgaggtgacttccgttagagtcggaccaacagtccggcccctggccggacacgacgccaacactactactcgaccgaccacacatacgactactaaaacttaattaaaagttaaaaggttgggttaggtttaatggttacgtaggttgggttactttaagtaattagtaccggtaggggaaccgaaaggggtactaaacgg

SEQ ID NO: 337182 - DNA, 611 bp, Homo sapiens
  misc_feature: GZ8MTXP02IH36U.44.29.C07.1.454.CMB.2.raw
  modified_base (210)..(210): a, c, t, g, unknown or other
  misc_feature (210)..(210): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcacctctctggttcncactcaggagtgatggagcgattggtgggcgtcggggtccgtcacggcccccgaggaaacggccctgggagtgggcttgcactctatttagtgggatgatgagtaggcgtactacacgtccatctcgtagaagngccagctctccatccgaccggngaccgcctaccaagtccgacgagtcaacttcgtagagtcggaccaacgtacgtccggcccctggacccgacacgacgccaaacgtacttacctacgttccgacacacatgaacttactaaacttaacgttaattaaaaggttagggttaggtttacgttaggttacggtaggttaccggtattttagaacgtttacgttacggtacgggggtaaccgaaacggtttaacggtaaagttacccggg

SEQ ID NO: 337183 - DNA, 547 bp, Homo sapiens
  misc_feature: GZ8MTXP02HH3QZ.44.29.C07.1.454.CMB.2.raw
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtgggctggggtccgtcagcccccaggaaacggccctggagtggcttgcactcatttatgggatgatgataggcgctacagtccatctctgaagngccagacctctccatccgaccggngaccgcctaccaatacgcaggtnatccttagngtggaccaanagtcggcccctgcggacacacgccaacattacactgccncacacatgactacaaacttaattaaataaaaggttggttagttagtcgtaggtaggttcgtgttttaagacgttacgtcggtaggggacccgtaaaaggggtacctaaagg

SEQ ID NO: 337184 - DNA, 684 bp, Homo sapiens
  misc_feature: GZ8MTXP02JZ2UI.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtgggctggggtccgtcacgcccccgaggaacggccctggagtggcttgcactctatttagtgggatgatgagtaggcgctacagtccatctcgtagaagagccagacctctaccagtaccgaccggacgacccgaccctaccaataccgacgtagggtctacgttaccgttaaggacggtcggaacccaacgtacgttcccgggaccccgttagggacccggaaccaaccgaacggaccccaaacgtacttaaccgtaaccgtcgggacccaccaaaccaacctagttacgtaaaccttaacctaaaactttaaaagtttaaaacgttaaaaagggtttgggttaaacggtttagtacggttacggtacggtttacggttacgtttaagtaagttacggttaccgggttacgggggaacccgtaaaagggggtaacctttaacgggg

SEQ ID NO: 337185 - DNA, 549 bp, Homo sapiens
  misc_feature: GZ8MTXP02H3RY7.44.29.C07.1.454.CMB.2.raw
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagacccctcacgctgacctgcaacctctctgggttctcactcaggagtgatggagcgattggtgggctggggtccgtcacgcccccgaggaacggccctggagtggcttgcactctatttagtgggatgatgataggcgctacagtccatctctagaagagccagactctccatccgaccgcgaccgcctaccaagtacgcgaggtagactccgtagagtcggaccaagactccggcccctaggccgacacncgaccacactactacnggccacacacagtcactactaaaactaatttaaagtaaaaggttggttagtttatggtagngttagtntttaagtatacgtcggtacggacgaacgggtactagg

SEQ ID NO: 337186 - DNA, 567 bp, Homo sapiens
  misc_feature: GZ8MTXP02HJ8GX.44.29.C07.1.454.CMB.2.raw
  modified_base (354)..(354): a, c, t, g, unknown or other
  misc_feature (354)..(354): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctggggtccgtcacgcccccaggaaggccctggagtggcttgcactcatttatgggatgatgataggcgctacagtccatctctgaagagccagactctccatccacggcgacncctaccatacgcaggtgactccgttagagtcggaccaacgacgtcggccccctggaccggacacctagaccctacacttacctacgtcggaccacacacattaggacttacaaaacttatttaaagtaaaacgggttggtttacggttaagttcggtagagttcggtactttaaggactttagtcgtagggggacccaaaggggtacctaagg

SEQ ID NO: 337187 - DNA, 645 bp, Homo sapiens
  misc_feature: GZ8MTXP02HCN5I.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgagtggagcgtagttggtgggcgttcggggtccgtcgacgacccccgaaggaaacggcccgtggagtggcttgctactctatttagtgggatgatgagtaggcgctacacgtccatctcgtagaagagccagtacctcctaccacgtaccgaacccgggacgtacccgaccctaccgtaaacgtaccggaccgtagggtacgtacttacccgttaaaggacggttacggacccaaacgtcgtcccggccccgtaggacccggaccacgacctacccaaactacttaacccgtacgcggaacccacaacccactagtaactaactaacctaaaatttaagttaaaagtaaaaggttgggtagtttagtagtacgtaggtcgttattaagtatacgtcggtacgggaaccgaaggtaactacgg

SEQ ID NO: 337188 - DNA, 744 bp, Homo sapiens
  misc_feature: GZ8MTXP02F6KF9.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgagtggagcgtagttggtgggcgtggggtccgtcgacggcccccgaaggaaacggcccgtggagtggctgcactctatttagtgggatgatgagtaggcgctacgacgtccatctcgtagaaagtacggccaacgtacctctaccacgtaccgaaccgggcgacccgtccctaaccgaaactaccggacgaacgggttacgtaaacttacccgtttaaggacggttacggaaccaaacgtaacgtcccgggtaccccgtcgggaaccggaaaccacgaaaccggcccctaaacgtaacttaacccgttaacgtccgggaccgaacccaaacgaaccgtaatacggtaaaccttaaaccgtaaaactttaaaacgtttaaaaacggttaaaaaggggtttggggtttaaacgggtttaaacttggggttacggtagggtttacgggttaccttttaaggtaagtttaacggttacgggttacgggggaaacccgttaaaagggggaaaaccctttaaacgggg

SEQ ID NO: 337189 - DNA, 667 bp, Homo sapiens
  misc_feature: GZ8MTXP02JWGQJ.44.29.C07.1.454.CMB.2.raw
  modified_base (399)..(399): a, c, t, g, unknown or other
  misc_feature (399)..(399): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgtagttggtgggcgtggggtccgtcacgcccccgaggaaacggccctggagtggcttgcactctatttatgggatgatgagtaggcgctacagtccatctctagaagagccagacctctaccactaccgaccgggacgaccgaccctaccaaactaccgcgagggtanacttacccgttaggacgtcggacccaaacgtacgtcccggccccctaggaccgaccgaaccgaccggacccaaactacgtaccgtaacctcggacccgaccaaccgactaacgtacgaacttaacctaaaactttaaagtttaaaacggttaaaaagggtttggggtttaaaggtttaacgttggttacggtaacggtttggtttacgttttaagaatttacggtccgggttacgggggaacccggtaaagggggtaccttaaacggg

SEQ ID NO: 337190 - DNA, 565 bp, Homo sapiens
  misc_feature: GZ8MTXP02FM8DM.44.29.C07.1.454.CMB.2.raw
  modified_base (317)..(317): a, c, t, g, unknown or other
  misc_feature (317)..(317): n is a, c, g, or t
  modified_base (437)..(437): a, c, t, g, unknown or other
  misc_feature (437)..(437): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtgggctggggtccgtcacgcccccaggaaacggccctggagtggcttgcatctatttatgggatgatgataggcgctacngtccatctctagaagagccagactctccatccaccggagaccgcctaccaaatccgacaggtcgatccgttaagagtcggaccaacgagtccggcccctggaccggacacacgaccctanactacctacgtcgaccgaccacacgatcaactactaaactaagttaaagtaaaagttgggttaaggttataggttgaagtggtcgtttaagaagttacgtcggtagggggaccaaggggacctaaggg

SEQ ID NO: 337191 - DNA, 640 bp, Homo sapiens
  misc_feature: GZ8MTXP02IAAZD.44.29.C07.1.454.CMB.2.raw
  modified_base (277)..(277): a, c, t, g, unknown or other
  misc_feature (277)..(277): n is a, c, g, or t
tcagacagtatatacacgaccggtgctcgatttagagtgctacgaagggaaagggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctctgtacagcatcaccagcacncgcccccagactcgtgtattttgaggtacaaataacgccgtcccgtcgacggggtcccgtagtcggttctccgtcggcctcgtaacgtctggacacgaccggtcctcccgtcgaccgtctcgtcggcctcgacggctgacgagtggacgtctagtactttacgttacgtcgcgtacgtccgtaccgtaggtagggacggtaccttaaccgttagttcggttagtttttcggtcggtttttcgggggacgggtaacgggtaaccggtacgtaaccggtacggttaacccggttccggtaacggttcccgaacggtaacccgaacggtccgtcccgtacccccgtccggtactacccgtttcccg

SEQ ID NO: 337192 - DNA, 586 bp, Homo sapiens
  misc_feature: GZ8MTXP02IK9HY.44.29.C07.1.454.CMB.2.raw
  modified_base (211)..(211): a, c, t, g, unknown or other
  misc_feature (211)..(211): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttcncactcaggagtgagtggagcgtattggtgggctggggtcccgtcacggcccccgagggaaacggcccgtggagtggcttgcactctatttagttggatgatgataggcgactacagtccatctctgaagngccagactctccatccgacgngaccncctaccaacgtaccgcgaggtcacttcgtaggacgtcgaccaacgngtcccggccctgaccggacacgacgacccaacgtactacctacgtgacccgacacaacagtacgactaacaaacttaagtttaaacgtaaaaggttggttaggtttaagtaggttcgaacgtttggtactttaagaattacggtcggtaggggaccgtaaaggggacctaagg

SEQ ID NO: 337193 - DNA, 652 bp, Homo sapiens
  misc_feature: GZ8MTXP02IR69Q.44.29.C07.1.454.CMB.2.raw
  modified_base (315)..(315): a, c, t, g, unknown or other
  misc_feature (315)..(315): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagacccctcacgctgacctgcaacctctctgggttctcactcaggagtgatggagcgattgtgggctgggtccgtcacgcccccgaggaaacggcccgtggagtggcttgcactctatttagtgggatgatgataggcnctacacgtccatctctgaagagccagacctctccaactcccgaaccgggacgaccgcccctacccgaaaacgttaccggacgtaaagggggtctaacgtttacccgttaaggacggtacgggaaccctaaacgtacgttcccgggcccccgtagggacccgggaaccaaccgaccggtacccaacaattacctaccgtcggaccaccaacacattacgaattaccaaaatttaagtttaaaagtaaaaagggtttggttagtttaaagtcggttaggtaggttggttcgtttaagattacggttcggtacggggtaaccgtaaagggtaactaacgg

SEQ ID NO: 337194 - DNA, 758 bp, Homo sapiens
  misc_feature: GZ8MTXP02J25D0.44.29.C07.1.454.CMB.2.raw
tcagacagtatatacacgaccggtgctcgatttagagtgctacgaagggaaagggggactcctgtgccccaccatggacacactttgctccacgctcctgctgctgaccatccttcatgggtcttgtcccagatcaccttgaaggagtctggtcctacgctggtgaacgcccacacacgaccctcacgctgacctgcaacctctctgggttctcactcgaggagtgagtggagcgtagttggtgggctcggggtccgtacgaccggcccccgaagggaaccggtcccgtagggaggtcgctttgacctactactagtttagtggattagatggagtaggcctactacgagtaccctatctacgaggaagacgacccacgtacctctacctacgaccgaaccggacgtaccgtaccctacaaacgaccgtacgtaacgggtactaaccgtttaccgttaaaggaccggttaccgggaacccaaaagttccgggtaccccgcccccgttagggaaccccgggtaaccaccgaaaccgttaccctaaacaaccgtttaaccctaacgcggaaccccacaaacccgtttaaacgtaacgttaactaaaccttaaacgttaaaacgtttaaaagtttaaaacgggttaacgggtttaggtttaacggtttagttacggttaacggttacggtttacgtttaagttaacggtaacggttacggtaccggggtaaaccgggaacgttaaaacggtaacgtaccgg

SEQ ID NO: 337195 - DNA, 564 bp, Homo sapiens
  misc_feature: GZ8MTXP02ITK94.44.29.C07.1.454.CMB.2.raw
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
tcagacagtatatacacgaccggtgctcgatttagagtgctacgaagggaaagggggactcctgtgccccaccatggacacactttgctccacgctcctgctgctgaccatccccttcatgggtcttgtcccagatcaccttgaaggagtctggtcctacgctggtgaagcccacacagaccctcacgctgacctgcaacctctctgggttctcactcaggagtgagtggagcgattggtgggcgtggggtcccgtcgacgccccccgaaggaaacggccctgggagtggcttgcactctatttagtgggatgatgagtaggcgctacagtccatctctgaagagccagactctccatccaccggngaccgcctaccaatacgcaggtnactccttaggagtcggaccaacagtccggcccgtgccggacacgacgcccaanactactactcgaccgcaacacatacgtactaactaaacttaattaaagtaaaaggttggttaggttagtgtaggtagttggtctttaagattacgtacggtggggaccaaggggtactaagg

SEQ ID NO: 337196 - DNA, 558 bp, Homo sapiens
  misc_feature: GZ8MTXP02H5IPW.44.29.C07.1.454.CMB.2.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (391)..(391): a, c, t, g, unknown or other
  misc_feature (391)..(391): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
  modified_base (522)..(522): a, c, t, g, unknown or other
  misc_feature (522)..(522): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttcctcactcaggagtgatggagcgattggngggctggggtccgtcgacgccccccgaggaacggcccgtgggagtggcttgcactctatttatgggatgatgataggcnctacagtccatctctagaagagcccagtacctcncctatccgaccggcgaccgccctaccaactacgcgagtnacttccgtagacgtcgaccaacgagtccggccccgtggcccggacacgacgccaanacttacacncgccgacaacacantaactacaaattaattaaagtaaaaggttggtagttagcggtagtagtggtntttaagatagtcggtagggaccgaagggtactacgg

SEQ ID NO: 337197 - DNA, 456 bp, Homo sapiens
  misc_feature: GZ8MTXP02HBFHC.44.29.C07.1.454.CMB.2.raw
  modified_base (349)..(349): a, c, t, g, unknown or other
  misc_feature (349)..(349): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (446)..(456): a, c, t, g, unknown or other
  misc_feature (446)..(456): n is a, c, g, or t
tcagacagtatatacacgaccggtgctcgatttagagtgctacgaagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcgggggattgcatactactactacggtatggacgtctggggccaagggaccacggtcaccgtctcctcagcttccaccaggcccatcggtcttcccctggcgccctgctccaggancccaccctcgtcgggggcacgacgccggcccgtggggctcgcctggtacagggactacttcctatntacngtctgngcggctggcaagcgcagtagnnnnnnnnnnn

SEQ ID NO: 337198 - DNA, 569 bp, Homo sapiens
  misc_feature: GZ8MTXP02JK68U.44.29.C07.1.454.CMB.2.raw
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtgggctggggtccgtcacgcccccaggaacggccctggagtggcttgcactcatttagtgggatgatgataggcgctacagtccatctctgaagngccagactctaccatccgacggcaccgcctaccaatacgcgaggtnactccgttagacgtcggaccaacgtacgtccgggacccctggaccggacaccgtacgcccaactactacctacgtcggaccacaaccgactagtcgaactacctaaataatttaaagtaaaaggtggttagttaagtgtagacgttggtatttaagacttagtcggtaggggacctaaaggggactaacgg

SEQ ID NO: 337199 - DNA, 455 bp, Homo sapiens
  misc_feature: GZ8MTXP02HYZ8A.44.29.C07.1.454.CMB.2.raw
  modified_base (369)..(369): a, c, t, g, unknown or other
  misc_feature (369)..(369): n is a, c, g, or t
  modified_base (444)..(444): a, c, t, g, unknown or other
  misc_feature (444)..(444): n is a, c, g, or t
  modified_base (447)..(455): a, c, t, g, unknown or other
  misc_feature (447)..(455): n is a, c, g, or t
tcagacagtatatacacgaccggtgctcgatttagagtgctacgaagggaaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactatactacggtatggacgtctggggccaaagggaccacggtcaccgtctcctcagcttccaccaagggccccaatcggtccttccccctggcgccctgctccaggagccacctcgtggggcncagcggccctggggctcgcctggtcaaaggacctacttcctaatactactgtctgagcgggctggcaaggcgcanagnnnnnnnnn

SEQ ID NO: 337200 - DNA, 609 bp, Homo sapiens
  misc_feature: GZ8MTXP02F7QD8.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgccaacctctctgggttctcactcaggagtgatggagcgtattggtgggcgtggggtccgtcgacgccccgaaggaaacggcccgtggagtggcttgcactctatttagttggatgatgataggcgctacacgtccatctcgtagaagagccacgacctcgtaccagtccgaccgggacgaccgccctaccaacgtaccgcgaaggtcaacgttcccgttagagtcggaccaaacgtcgtcccggacccccgtggacccgaaccacgaaccgccaaactacgttaccgacgtcggaccgaccaacactagtagtaactaactaaaacttaagtttaaaacgtaaaaggttggttagttagtggtagtagttggtactttgattacggtcggaggggaccgtaaggacgttaacgg

SEQ ID NO: 337201 - DNA, 517 bp, Homo sapiens
  misc_feature: GZ8MTXP02ITWGD.44.29.C07.1.454.CMB.2.raw
tcagacagtatatacacgaccggtgctcgatttagagtgctacgaagggaaaggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcaatttcattggtaatcatgactatgtctcctggtaccagcatcacccaggcacacgcccccagactcgtgtattttgaggtcaataagccgcccctcgacggggtcccgatcggttctccgtggcctcaagtctggcacaccggcctccctgaccgtctctgggctccgaggctgacgatgaggctgattattactgcagctccgatggagcacatgattgctttcggcgtacggacagacgtgaccgtcctaggtccagcccgaaggcctcgcccctcggtccacgtcc

SEQ ID NO: 337202 - DNA, 620 bp, Homo sapiens
  misc_feature: GZ8MTXP02GAA8O.44.29.C07.1.454.CMB.2.raw
  modified_base (459)..(459): a, c, t, g, unknown or other
  misc_feature (459)..(459): n is a, c, g, or t
tcagacagtatatacacgaccggtgctcgatttagagtgctacgaagggaaaggggggggtctcaggaggcagcgctctcaggacgtcaccaccatggcctgggctctgctcctcctcacccctcctcactcaggacacagggtcctgggcccagtctgtcctgactcagcctccctccgcgtccgggtctgtcggtcagtcagtcaccatctcctgcactggaaccagctaatttcattggtaatcatgactatgtctctggtaccagcatccacccaggccacaccgcccccagactcgtgtattttgagtacaataacgccgccccgtcgacggggtccgagttccggttctcccgtccgctaccgagtcgtacgacaccgccgtccctcccgtcgacccgtctcgtcgggtccctccgaggccgtgacgtacgtgacggtctagtacttattacngctacgcgtcgagtggacgtcctacgttatgttacgtttgttcgtttcgggacggtacgggacctacgggtaccgtacggtacccgttaccgtacggtaccgtacggtccccgtaacgggcccttacccgcccccgttacggtacccgtaccgtttccccg

SEQ ID NO: 337203 - DNA, 560 bp, Homo sapiens
  misc_feature: GZ8MTXP02H8QBT.44.29.C07.1.454.CMB.2.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (471)..(471): a, c, t, g, unknown or other
  misc_feature (471)..(471): n is a, c, g, or t
  modified_base (510)..(510): a, c, t, g, unknown or other
  misc_feature (510)..(510): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagacccctcacgctgacctgcaacctctctggtctcactcaggngtgatggagcgattggngggctggggtcccgtcacgacccccgaggaacggccctggagtggcttgcactctatttagtgggatgatgagtaggcgcttacacgtcccatctactaggaagacgaccagtacctctaccataccgaaccgggcgaccgccctaaccaacgtacgcgagtagtactcgtagngtcgaccaagacgcggcccctgaccgacncacgcctacacttacacgtgacacacatagnactacctaaattaaattaagtaaaagttggtacgttagngttagaggttgtacgtttaagagttgtcggtacgggacgaaggtactacg

SEQ ID NO: 337204 - DNA, 621 bp, Homo sapiens
  misc_feature: GZ8MTXP02F8SAJ.44.29.C07.1.454.CMB.2.raw
  modified_base (362)..(362): a, c, t, g, unknown or other
  misc_feature (362)..(362): n is a, c, g, or t
  modified_base (492)..(492): a, c, t, g, unknown or other
  misc_feature (492)..(492): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgatggagcgattggtgggcgtggggtccgtcacggcccccgaaggaacggcccgtggagtggctgcactcatttagtggatgatgataggcgctacgagtccatctctagaagagccagacctctccactaccgaccggngacccgcctaccgaaactaccgacgagggtacgtacttccgttaaaggacggtcgaacccaagacgtccgggcccctggacgaaccacgacgacccaaacgtactaaccgtactcggaccgaccaaccanactagtaactactaaaactttaagttaaaagtaaaaggtttgggttaggttattagggtagttaacggtggtttaatttgaagtttacggtaccgggacgggggaaccgtaaagggggtactaaacggg

SEQ ID NO: 337205 - DNA, 752 bp, Homo sapiens
  misc_feature: GZ8MTXP02GSE1C.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaacgcccacacagaccctcacgctgacctgcaacctctcgtgggttctcactcgaggagtgatgggagcgtagttggtgggcgtcggggtccgtcgaccgccccgaagggaacggcccgtggagtggtctgctactctatttagtgggatgatgagtaggcacgtacacgtcctatctacgtagaacggacgaccaacgtacctcctaccacgtaccggaaacccgggacgacccgtaccccttaaccgaaacgtacccggacgtacgggttacgaaaccgtttccgtaaagggtcgtaccggaacccaaacgtaccgtcccggtaccccgtacggaaccggaaccaaccggaaaccgtacccaaacgtaaccttacgttaaccgtcggaaccgaccctaaacactaacgtaacgtaaacttaacgtaaaaacgttttaaaattaaacggttaaaaacggggtttgggtttaaacgggtttaaagtcggggtttaccggtaagggtttccgggttaatttaacgggtaagtttacgggttacggggacggggtaaaacccgtaaaagggggtaaccttaaacgggg

SEQ ID NO: 337206 - DNA, 563 bp, Homo sapiens
  misc_feature: GZ8MTXP02IR43T.44.29.C07.1.454.CMB.2.raw
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (433)..(433): a, c, t, g, unknown or other
  misc_feature (433)..(433): n is a, c, g, or t
  modified_base (508)..(508): a, c, t, g, unknown or other
  misc_feature (508)..(508): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattggtgggctggggtcccgtcacgccccccgaggaaacggcccgtggagtggcttgcactctatttagtgggatgatgataggcgactacagtccattcctctgaagagccacgacctctaccataccacccggngaccgcctaccaatcgacaggtnatcttagagtcggaccaacgatccggaccctggaccggaacncacgaccaactactactacctgccacacacatagactacaaacttaattaaaagtaaaaggttggtaggtttaanggttagacggttgtcgtttaagactttgacggtggggaactaacggggactaagg

SEQ ID NO: 337207 - DNA, 645 bp, Homo sapiens
  misc_feature: GZ8MTXP02FNXBH.44.29.C07.1.454.CMB.2.raw
  modified_base (213)..(213): a, c, t, g, unknown or other
  misc_feature (213)..(213): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgccaacctctctgggttcncactcgaggagtgagtggagcgtagttggtgggcgttggggtcccgtacgacgacccccgaggaaacggcccgtaggagtggcttgctactctatttagtgggatgatgagtaggcgactacgacgtcctattctacgtagaagacgacccgacgtacctcctaccacgtacccgaccggacgacccgaccctaccgaaacgtccgacgtagggtactattcccgttaaggacgtaccggaccctaacgacgtcccggcccctaggaccgaacaccgacgaccaactacctactaccgagaccgacctacgacgaatacaataacctaaagttaagttaaagtaaaaggttggttacgttaagtcggtagtacggtaggttacgttaagtacgtacgttagggaccgggaaccgtaaggggtacttaacggg

SEQ ID NO: 337208 - DNA, 796 bp, Homo sapiens
  misc_feature: GZ8MTXP02FL40J.44.29.C07.1.454.CMB.2.raw
  modified_base (545)..(545): a, c, t, g, unknown or other
  misc_feature (545)..(545): n is a, c, g, or t
  modified_base (587)..(587): a, c, t, g, unknown or other
  misc_feature (587)..(587): n is a, c, g, or t
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcacctctcgtggtctcactcaggagtgagtggagcgtagttggtgggtctcggggtccgtcgacggacccccgagggaacggcccgtggagtggctgctactactagttagtgggtatggataggagtacggcggtactaaccgtacgtcctacgttcctacgtaggtaaacggacgacccgtacgtacccttacccgtaccttaacgaccccgaacgggtaccgtaacccggtacccctaaaccgtaaacgtaccggacgtaggggtacctaaaccgttacgttaaaggacggttaccggaaccctaaaacgtcggtcccccggtacccccgtagggaaccggtaaacnccgtaaaccgaccctaaactaacgtaacccgtacgaaccggnaaccccgaactaacggtaataccggaaactttaacctaaaaacggttttaacttaaaaacggttaaaacggtttgggggtttaaacgtttacggttaagggtcccgggtttaagggggttaccgttttaaccggtttggtaaaacgtttaccggggttaccggggtacgggggtaaaaccccgaaagggggttaactttaaaacccggg

SEQ ID NO: 337209 - DNA, 628 bp, Homo sapiens
  misc_feature: GZ8MTXP02GHBDL.44.29.C07.1.454.CMB.2.raw
tcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctggttctcactcaggagtgatggagcgtattggtgggctggggtccgtcacgcccccgaggaacggccctggagtggcttgcactctatttagttgggatgatgagtaggcgactacacgtccattctcgtagaagacgaccgacgtacctctacctacgtaccgaaccgggacgacccgtaccctaccaaagtaccggacgagggtacgtactacgttaaaggacggtacggacccaaacgtacgtccggcccccgtaggacccggaaccacgacgccaacactacctacgcggaccaccacactatacgataaccgtaattaattaaacgtaaaaggttggttagtttagtaggttacgtaacgttgtagtttaagtagttacggttacggtacggggaacccgtaaagggtacgttaacgg

SEQ ID NO: 337210 - DNA, 472 bp, Homo sapiens
  misc_feature: GZ8MTXP01DBVAY.10.11.A11.1.454.CMB.2.raw
  modified_base (374)..(374): a, c, t, g, unknown or other
  misc_feature (374)..(374): n is a, c, g, or t
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (461)..(472): a, c, t, g, unknown or other
  misc_feature (461)..(472): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttatcatcatgatggttctactatattacgagagatctgagtttgaccactgggccagggcatgctagtcaccgtctccccagcctccaccccaggccatcgctcccctgcaccctctccaancgcactctggggcacacgcgcctgggctgcctggcaaggactactcccacgtactatncgtgagcgggctggcaaggccgngaangnnnnnnnnnnnn

SEQ ID NO: 337211 - DNA, 486 bp, Homo sapiens
  misc_feature: GZ8MTXP01CP6IC.10.11.A11.1.454.CMB.2.raw
  modified_base (367)..(367): a, c, t, g, unknown or other
  misc_feature (367)..(367): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (474)..(486): a, c, t, g, unknown or other
  misc_feature (474)..(486): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctactatattacgagagatctgagtttgaccacgtggggccagggcatgctagtcaccgtctccccagcctccaccccaaggccatcgtccttccccnggccaccctcctccaagacgcacctcgtggggcacgacgccggcctgggctgcctggtcaagctacttcccactactatgctgagcggctggccaagggcncaangnnnnnnnnnnnnn

SEQ ID NO: 337212 - DNA, 483 bp, Homo sapiens
  misc_feature: GZ8MTXP01CHFVS.10.11.A11.1.454.CMB.2.raw
  modified_base (477)..(483): a, c, t, g, unknown or other
  misc_feature (477)..(483): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctactattattacgagagatctgagtttgaccactggggccaggggcatgctagtcaccgtctccccagcctccaccccaagggccatcggtcttccccctggccaccctccctcccaagacgcacctctgggggcacagcggccctgggctgcctggtcaaggctacttcccactactatgctgagcgggctggcgaaggcgcatgnnnnnnn

SEQ ID NO: 337213 - DNA, 669 bp, Homo sapiens
  misc_feature: GZ8MTXP01CZ37L.10.11.A11.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
tcagcatagtagtgcacgaccggtgctcgatttagctacgactgcgaaggggaaaggggggggtctcaggaggcagcgctctcgggactctccaccatggcctgggctctgctattcctcaccctcctcactcagggcacagggtcctgggccagtctgccctgactcagcctgactccgtgtcgtgggtctcctggacagtcgatcactatcctctgcacgtgaccacagcagtnacagtaggtntacttaataactatcgtctctagtaaccaacaaccaccacgaccacgccccaagactactatacgttattttagattcgtacgtaagtaaccgtcggtcccttacggtaggggttttactacctcggtcttctacgtcggtaacctacgtaacgtcgtacggaacctaaccgaccggtccctcccgtacacctagtcgtcgcggtcctccgaggtccgtaggacggacgacgttctaagttacgttacgtacgtacgactacgtactaacgtaactaacgaaccaacgtaacgtaccgtacgttacttaacgttcgttacggtacggttaccggggtaaacggaacggttaaccgttacgttaccggttaacccggtaaccgttcgtaccggtaccgacccgggtaaccgttaacggtccccg

SEQ ID NO: 337214 - DNA, 487 bp, Homo sapiens
  misc_feature: GZ8MTXP01DOQJ1.10.11.A11.1.454.CMB.2.raw
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (477)..(487): a, c, t, g, unknown or other
  misc_feature (477)..(487): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatccgccgctgacacggccgtctatttcngcgcgtcctcattcccttattcatcatgatgttctactatatacgaganatctgagtttgaccacgtggggccaggggcatgctagtcaccgtcctccccagcctccacccacggccatcgtctccccctgccaccctcnccagcncacncgtggggcacncggcgccctggctgcctggtacaaggactaccttacccactactatcgcgtgaggcggcgtaggcgaaggcgcgaatgnnnnnnnnnnn

SEQ ID NO: 337215 - DNA, 517 bp, Homo sapiens
  misc_feature: GZ8MTXP01AWX8T.10.11.A11.1.454.CMB.2.raw
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (502)..(517): a, c, t, g, unknown or other
  misc_feature (502)..(517): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcactctccctttcactggacctgtctgagaaccagttctccatgacactgacctctgtcatcgccgctgacacggcctntatttcngcgcgtcctcacttcccttatcatcatgatggttctactattatacgagagatctgagtttgaccacgtgggccagggcatgctagtcaccgtctccccagcctaccacccgaacggccagtccggtccctccccctaggcccaccctcctccaacgcgccactcgtcggggcacgacggccgccgtgggctcgccgttggtacaacggtacctaccttcccaactactatcgcctgacggcgggcgtggcgaaggcgactaggaacnnnnnnnnnnnnnnnn

SEQ ID NO: 337216 - DNA, 672 bp, Homo sapiens
  misc_feature: GZ8MTXP01CTPBI.10.11.A11.1.454.CMB.2.raw
  modified_base (652)..(652): a, c, t, g, unknown or other
  misc_feature (652)..(652): n is a, c, g, or t
  modified_base (654)..(657): a, c, t, g, unknown or other
  misc_feature (654)..(657): n is a, c, g, or t
  modified_base (659)..(672): a, c, t, g, unknown or other
  misc_feature (659)..(672): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctctacttcccttattcatcatgtatgttctaactattatacgagagtatctgtagtttcgacctacggtcggggccagggctagtgacttacgtccacccgttccctacccccgacgtcccctacccgaacccccgaaccgggggtccctaacgtttccccgggttccccctttacccccccggtcgggtccccctaacccccgttcccctaacccgaaaccggtcgaccccgtaccccggtcgggtacgggggccaaccggacgggcccgggtccccggtggggccgtccgggcccgttacgggtaccgaaacggtacccttaacccgttaccccgtaacttaccgttaacgtcgtacgtacggacgggtccggggtcgtacgggaccgaacgggaccgctaaaggngnnnngnnnnnnnnnnnnnn

SEQ ID NO: 337217 - DNA, 587 bp, Homo sapiens
  misc_feature: GZ8MTXP01CCI8Q.10.11.A11.1.454.CMB.2.raw
  modified_base (230)..(230): a, c, t, g, unknown or other
  misc_feature (230)..(230): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(575): a, c, t, g, unknown or other
  misc_feature (573)..(575): n is a, c, g, or t
  modified_base (577)..(587): a, c, t, g, unknown or other
  misc_feature (577)..(587): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatccgccgctgacacggccgtntattctgccgcgtctcatcccttatcatcatgatggttctacttattatacgagagatctgtagtttgacccacgtgggccagggcatgtctagtcacccgtcncccncgccctccaaccccgacgggccagtccgtcccttacccccgcggcccacccgtcccctaccgaacgcgcctaccgtcgtacggggcaacgcgggccggtcccgtcgggtccgtcggtacccgttcgggtaccgtaaacgggtacccttaaccttaccccaacgttacttaaagtcgaccgtggtaccggccggggtcgtcgggacgtaaacgggcgtaccgaagngngngngngnnngnnnnnnnnnnn

SEQ ID NO: 337218 - DNA, 683 bp, Homo sapiens
  misc_feature: GZ8MTXP01A9OWK.10.11.A11.1.454.CMB.2.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
  modified_base (666)..(666): a, c, t, g, unknown or other
  misc_feature (666)..(666): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
tcagcatagtagtgcacgaccggtgctcgatttagctacgactgcagggtgtacacctgtggttctcggggccgccggaaagggcccggagtggcttggtcggatctctctcactgggaacacctatacaaccctctttcatgggtcactctcctttcactggacctgtctgagaaccagttctccatgacactgacctctgtcatccgccnctgaccacggtccgtctactttcngcgtcgtcctcactcccttatcatcatgattgtctactatatacgaganatctgtagttcgactacggcgggcaggctatcgtctacgtccaccgtcctccccgatccctaccgaacccgacggtcctacgttcccgggttcccttaacccccgtgggccccctacccccgtacccgtaccgaaacgtacgaccccgtaaccgtcggggtacggggaccctaacgcgggcccgggtcccgtggggaccctcggtaccgttacgggaccgtaaaacggtccctttaacccttaacccccgtaattaccgtttaacgcggttaacccggggtacggggacccgggtcgggggttaccgtaaccggggggaaccggttaaccgggggacccgtaacgtaaaggggtaactcgacgtcgcgactcgcgcgacgngcgcgntcnctcncgcg

SEQ ID NO: 337219 - DNA, 521 bp, Homo sapiens
  misc_feature: GZ8MTXP01AU4XY.10.11.A11.1.454.CMB.2.raw
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (381)..(381): a, c, t, g, unknown or other
  misc_feature (381)..(381): n is a, c, g, or t
  modified_base (502)..(505): a, c, t, g, unknown or other
  misc_feature (502)..(505): n is a, c, g, or t
  modified_base (507)..(519): a, c, t, g, unknown or other
  misc_feature (507)..(519): n is a, c, g, or t
  modified_base (521)..(521): a, c, t, g, unknown or other
  misc_feature (521)..(521): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggcgtctatttcngcgcgtcctcattcccttattcatcatgatgtctatattatacgagacgatctgatttgaccagtggggccnggcatgctagcaccgtcnccccagcctcaccacggccagtcccggtctccccctgccaccctccgtacaaacgngccaccgtcgtgggggacacgacgccggcccgtgggacctcgccgtcggtacgaacggactactacccctacgtacctagttcgccgtagacggtcggcgtcggacgaacggcgcgaagtnnnngnnnnnnnnnnnnngn

SEQ ID NO: 337220 - DNA, 461 bp, Homo sapiens
  misc_feature: GZ8MTXP02IUSS9.10.11.A11.1.454.CMB.2.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (383)..(384): a, c, t, g, unknown or other
  misc_feature (383)..(384): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (448)..(461): a, c, t, g, unknown or other
  misc_feature (448)..(461): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttctactggacctgtctgagaaccagttctccatgacactgacctctgtcatcgccgctgacacggccgtctatttctgcgcgtcctcatcccttattcatcatgatggttctacttattatacgagagatctgagtttgaccacgtggggccaggcatgctagtcaccgtctccccagcctccaccaagggcccatcggtctccccngcacctcncangcncnngggnancgngccnggcncgcngtcagactactcccatactanctgagcggctgcgagcgcnagnnnnnnnnnnnnnn

SEQ ID NO: 337221 - DNA, 551 bp, Homo sapiens
  misc_feature: GZ8MTXP02HRVSZ.10.11.A11.1.454.CMB.2.raw
  modified_base (236)..(236): a, c, t, g, unknown or other
  misc_feature (236)..(236): n is a, c, g, or t
  modified_base (332)..(332): a, c, t, g, unknown or other
  misc_feature (332)..(332): n is a, c, g, or t
  modified_base (512)..(512): a, c, t, g, unknown or other
  misc_feature (512)..(512): n is a, c, g, or t
  modified_base (533)..(533): a, c, t, g, unknown or other
  misc_feature (533)..(533): n is a, c, g, or t
  modified_base (535)..(551): a, c, t, g, unknown or other
  misc_feature (535)..(551): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttcngcgcgtcctcatcccttattcatcatgatgttctacttattattacgagagatctgagtttgaccacgtggggccagggcatgctagtcaccgtcnccccagcctccaccccaagggccccatccggtccttccccccgtggccaccccttcctccaagacgccacctcgtcgggggcaccgacggccggccccgtggggtcctcggtcccgtgggtaccgaaacgggaccttaacctttccccaacttaccttatcgcgtaggacgccggggtcncgggacgaacgggcgacaagngnnnnnnnnnnnnnnnnn

SEQ ID NO: 337222 - DNA, 514 bp, Homo sapiens
  misc_feature: GZ8MTXP02H8VGI.10.11.A11.1.454.CMB.2.raw
  modified_base (286)..(286): a, c, t, g, unknown or other
  misc_feature (286)..(286): n is a, c, g, or t
  modified_base (500)..(514): a, c, t, g, unknown or other
  misc_feature (500)..(514): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacganagatctgagtttgaccacgtggggccaggggcatgctagtcaccgtctccccacgccctcaccccgagggcccatccgtcttccccctgccacccctcctaccaagcgccactcgtcgggggcacgacgccggcccgtgggctcgccgtggtacacggtactaccttcccacgttacttatgcgtgaggacggcgtggcgaaggcgacagtagnnnnnnnnnnnnnnn

SEQ ID NO: 337223 - DNA, 476 bp, Homo sapiens
  misc_feature: GZ8MTXP02JM7FF.10.11.A11.1.454.CMB.2.raw
  modified_base (238)..(238): a, c, t, g, unknown or other
  misc_feature (238)..(238): n is a, c, g, or t
  modified_base (465)..(465): a, c, t, g, unknown or other
  misc_feature (465)..(465): n is a, c, g, or t
  modified_base (469)..(476): a, c, t, g, unknown or other
  misc_feature (469)..(476): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggacgtctattctgcncgtcctcatcccttattcatcatgatggttctacttattattacgagagatctgagtttgaccactggggccagggcatgctagtcacgtctcccagcctcaccccaaggcccatcggtcttccccctggccaccctcctccaacgagcacctctgggggcacgagcgccctgggctgcctggtcaaggctactccactactatgctgagcgggctggcaaggcgcntagnnnnnnnn

SEQ ID NO: 337224 - DNA, 707 bp, Homo sapiens
  misc_feature: GZ8MTXP02HDSS9.10.11.A11.1.454.CMB.2.raw
  modified_base (242)..(242): a, c, t, g, unknown or other
  misc_feature (242)..(242): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (687)..(688): a, c, t, g, unknown or other
  misc_feature (687)..(688): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
  modified_base (694)..(696): a, c, t, g, unknown or other
  misc_feature (694)..(696): n is a, c, g, or t
  modified_base (698)..(699): a, c, t, g, unknown or other
  misc_feature (698)..(699): n is a, c, g, or t
  modified_base (701)..(702): a, c, t, g, unknown or other
  misc_feature (701)..(702): n is a, c, g, or t
  modified_base (704)..(704): a, c, t, g, unknown or other
  misc_feature (704)..(704): n is a, c, g, or t
  modified_base (706)..(707): a, c, t, g, unknown or other
  misc_feature (706)..(707): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctataccaacccctctttcatgggtcgactctccctttcactggacctgtctgagaaccagttctccatgacactgacctctgtcatccgccgctgaccacggccgttcttactttcncgcgtccgtcctctacttcccttatcatcatgattgttactactttaattatacgagatacttcgtagtacgtttcgacctacggtcggggaccaagggctagtcgacttacgtccctacccgtccctaccccgacgcccctaccaaccccggacgggtcccctacgttcccggttcccctcccccgtcgccccctaccccctacccgtaaccgaaacgtccgtacccgtacccggttcggggtacgggggacccacccggaccgggtccccggggtcccggtcggggtcccgttaccggtcccggttacgggtaacccgtaaaccggttaacccttaccccgttaaccccgttaaacgttacctttacgaccggtacgggttacggaccggggtccgggtaccgtacggggaaccggaaacgggccaacgtaagtacggngncnncncncnnngnngnncncnn

SEQ ID NO: 337225 - DNA, 523 bp, Homo sapiens
  misc_feature: GZ8MTXP02FWM2U.10.11.A11.1.454.CMB.2.raw
tcagcatagtagtgcacgaccggtgctcgatttagctacgactgcaagggaaagtggggggtctcaggaggcagcgctctcgggacgtctccaccatggcctgggctctgctattccctccaccctcctcactcagggcacagggtccgtgggcccagtcgtgccctgactcagcctgactccgtgtctgggtctcctggacagtcgatcactatctcctgcactggcaccagcagtgacataggtgcttataactatgtctcctggtaccagccaccacccaggccaaacgcccccaaactccttgttttgaggtcagtaagcggccctcaggacgtccctgactcggttctctcgcctccaagtctggcaacaccgcctccctgacccgtctctggggctccgaggctgaggatgaggctgattacgtactgcagcgcatatcacgccccagaggtgttggcggcggataacggtgaccgtcgcggtcacggccgaaggctcgccccctcggtccactccg

SEQ ID NO: 337226 - DNA, 647 bp, Homo sapiens
  misc_feature: GZ8MTXP02F80AO.10.11.A11.1.454.CMB.2.raw
  modified_base (260)..(260): a, c, t, g, unknown or other
  misc_feature (260)..(260): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
tcagcatagtagtgcacgaccggtgctcgatttagctacgactgcgaagggaaagggggggtctcaggaggcagcgctctcgggacgtctccaccatggcctgggctctgctattcctcaccctcctcactcagggcacgagggtcctgggcccagtctgccctgactcagcctgactccgtgtctggtcctccgtggacagtcgatcactatctctgcacgtgaccacagcagtcacagtaggtcgactttaataactntacgtcctccgtacgtaacccaacaaccaccgacggacccgacggacccccaagacctcagttcgttattttacgagtacgtactaaggttacgtcccggaccttcggttacggggtttactaccgtcgttcttcgttcgtcgccttaacgacgttcgacggaacctacccgtaccgggccctttacccgacgtaaaccctcgttcgtccggtcgggtcctacggcgtacgtaggaacggacgtacgcttagtaactttacgtacgngtacgtacnctactaacttacaaccgaacacgacgataccgtacttacgtaggttacgtcggacggtacgacgacgtactaacggtccgtacgtacgacgtaccgtccgaacggtccccg

SEQ ID NO: 337227 - DNA, 523 bp, Homo sapiens
  misc_feature: GZ8MTXP02GLY7E.10.11.A11.1.454.CMB.2.raw
  modified_base (367)..(367): a, c, t, g, unknown or other
  misc_feature (367)..(367): n is a, c, g, or t
  modified_base (506)..(513): a, c, t, g, unknown or other
  misc_feature (506)..(513): n is a, c, g, or t
  modified_base (516)..(523): a, c, t, g, unknown or other
  misc_feature (516)..(523): n is a, c, g, or t
tcagcatagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatgttctacttattattacgagagatctgagtttgaccactggggccaggggcatgctagtcaccgtctccccagcctccacccaggcccatcgtcttcccccnggccaccctcctccaagacgcacctctcgggggcacgacgccggccctggggcctacggccgtcgggtacgaaacgggaccttaacgttcccccactacctagtcgctgacgcggggtcgtggcgaggcgcacgtacgnnnnnnnnccnnnnnnnn

SEQ ID NO: 337228 - DNA, 524 bp, Homo sapiens
  misc_feature: GZ8MTXP01A4KGV.2.28.C06.1.454.CMB.2.raw
  modified_base (398)..(398): a, c, t, g, unknown or other
  misc_feature (398)..(398): n is a, c, g, or t
  modified_base (491)..(491): a, c, t, g, unknown or other
  misc_feature (491)..(491): n is a, c, g, or t
  modified_base (517)..(524): a, c, t, g, unknown or other
  misc_feature (517)..(524): n is a, c, g, or t
tcagacgctcgacacacgaccggtgctcgatttagagctcacgtattgggtttggtccagcctggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgccaagaactcactgtatctgcaaatgaacagcctaaagacccgaggacacggctgtgtattactgtgcgagagacccgctacgtgggggcccggagcccctggtcccaccggtctccctcagccctccaaccaaggggccccatcggtcttcccccnggccgcccctgcctcccagggacgcaccctccgagacgcacagcggcccctgggggctgccctggtccaaggctactcctgtcgagcgtctgngcgggcttgggcaagggcgcataagnnnnnnnn

SEQ ID NO: 337229 - DNA, 558 bp, Homo sapiens
  misc_feature: GZ8MTXP01DLJDM.2.28.C06.1.454.CMB.2.raw
  modified_base (269)..(269): a, c, t, g, unknown or other
  misc_feature (269)..(269): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
  modified_base (551)..(558): a, c, t, g, unknown or other
  misc_feature (551)..(558): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccattcaccatctccagagacaacgccaaagaactcactgtatctgcaaangaaacagcctaaagacccgaggacacggctgtgtattactgtgcgagagaccgctacgtgggggcccggagcccctggtcccaccggtctccctcacgcccctaccaacccgaaacggggccccaagttccgggtcccttccccccgtgggcccgccccttgcctcccgaggacgccacccgtccgagacgccacaggccgcccctggggggctggcctggtacaacggctacttccngtcgagcgtntggaggcgggcttgggcgaacgggcgcagtaagnnnnnnnn

SEQ ID NO: 337230 - DNA, 622 bp, Homo sapiens
  misc_feature: GZ8MTXP01EL888.2.28.C06.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (599)..(599): a, c, t, g, unknown or other
  misc_feature (599)..(599): n is a, c, g, or t
tcagacgctcgacacacgaccggtgctcgatttagagctcacgtattgggtttggggtctcagagaggagccttagccctggactccaaggcctttccacttggtgatcagcactgagcacagaggactcaccatggaattggggctgagctgggttttcctgttgccattttagaggtgtccagtgtgaggtgcagctggtggagtcgtgggggaggtttggtccaggccgtggggggtccctgagactctcgtgtgcgcctctggattcatctctaacaaactnttggatgagctgggtccgtnaggctccgaggggaaggggctggagtgggtggccagcagtggaaccggagagtaggaaagtacaaaaaaaaggaactaagtgtagggacttcgtggtagggaacggggtacccgtattacacccatcctaccgaaggaacgaaccaaccgaccaaaagaacctacaactgtaactactagtaaccaaataggaacaacggaccctaaacggaccccgagggaaccacggtctggtacgttattacgttgtgacggttagcggacccgtcgtaccggtccgggggaccccgggngccccgtgggttcccaaccccgg

SEQ ID NO: 337231 - DNA, 577 bp, Homo sapiens
  misc_feature: GZ8MTXP01CXMGK.2.28.C06.1.454.CMB.2.raw
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (568)..(568): a, c, t, g, unknown or other
  misc_feature (568)..(568): n is a, c, g, or t
  modified_base (570)..(575): a, c, t, g, unknown or other
  misc_feature (570)..(575): n is a, c, g, or t
  modified_base (577)..(577): a, c, t, g, unknown or other
  misc_feature (577)..(577): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagactatgtggactctgtgaagggccattcaccatctcagagacaacgccaagaactcactgtatctgcaaatgaacagcctaagacccgagacacggctgtgtattacngtgcgagagacccgctacgtgggggccccggagccctggtcccaccgtctcctcacgcccctccaaccgaacgggccccagtccggtcccttcccccgnggcccnccctgcctccgaggcgccaaccgtccgagacgcacgacggccggccccgtggggggcctcggtccctcgggtaccaaacgggtaccttacgtttccctggttccgacgtccggttctgggacgggccggggaccgttgggaccgaacgggccgcttaagngnnnnnngn

SEQ ID NO: 337232 - DNA, 585 bp, Homo sapiens
  misc_feature: GZ8MTXP01C9PCH.2.28.C06.1.454.CMB.2.raw
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
  modified_base (422)..(422): a, c, t, g, unknown or other
  misc_feature (422)..(422): n is a, c, g, or t
  modified_base (573)..(573): a, c, t, g, unknown or other
  misc_feature (573)..(573): n is a, c, g, or t
  modified_base (577)..(585): a, c, t, g, unknown or other
  misc_feature (577)..(585): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccgagggaaggggctggagtgggtggccagcatgaacggagatggaagtcaaaaagaactatgtggactctgtgaagggccattcaccatctcagagacaacgccaagaactcactgtatctgacaaangaacagacctaaagacccgaggacacggctgtgtattacngtgcgagacgaccgctacgtcgggggcccggagccctggtccccaccgtctcctcacgcccctaccgaaccgaaacgggcccctaagttcccgggtcccctttccccccggngggcccctcccgtcgcctaccgacggaccgacccacccgtccgagacgaccacgcggcccggcccgtgggggctcggtccgtacggtaccgaacgtccttaccgttccgtcgtccgacgtccgtgcggcggcgggcgcgggacgacggcgnagtnnnnnnnnn

SEQ ID NO: 337233 - DNA, 650 bp, Homo sapiens
  misc_feature: GZ8MTXP01B25IV.2.28.C06.1.454.CMB.2.raw
  modified_base (561)..(561): a, c, t, g, unknown or other
  misc_feature (561)..(561): n is a, c, g, or t
tcagacgctcgacacacgaccggtgctcgatttagagctcacgtattgggtttggggtctcagagaggagccttagccctggactccaaggcctttccacttggtgatcagcactgagcacagaggactcaccatggaattggggctgagctgggttttccttgttgccattttagaaggtgtccagtgtgaggtgcagcgtggtggagtcgtgggggaggtttggtccgagccgtgggggtccctgagactctcgtgtggcgcctctggattcatctctaacaaacttatggatgagtcgtgggtccgtcgaggctccgaggggaagggcgtggagggtgggtggccagcagtaggaaccggagagtggaaagtacaaaaaagactaagtgtaggactcgtaggtaggaacggggcctagttccacctatcctaccgaagaacgaaccgaaaccgacccaaagaaccctcaacgttacgtaacttctagaaccaaagtcgaaaccacggaccgtaaacgacccggaagtaccgaacggtctaaggttagttactttacgngttacggcgaaagggcgacccggtaaccggttaccgggtccggggggacccccggacggttccccggttaaggttccccgtaaccccgg

SEQ ID NO: 337234 - DNA, 584 bp, Homo sapiens
  misc_feature: GZ8MTXP01AH0T2.2.28.C06.1.454.CMB.2.raw
  modified_base (230)..(230): a, c, t, g, unknown or other
  misc_feature (230)..(230): n is a, c, g, or t
  modified_base (421)..(421): a, c, t, g, unknown or other
  misc_feature (421)..(421): n is a, c, g, or t
  modified_base (558)..(558): a, c, t, g, unknown or other
  misc_feature (558)..(558): n is a, c, g, or t
  modified_base (573)..(573): a, c, t, g, unknown or other
  misc_feature (573)..(573): n is a, c, g, or t
  modified_base (577)..(584): a, c, t, g, unknown or other
  misc_feature (577)..(584): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccgagggaagggctggagtgggtgccagcatgaacggagatggaagtacaaaaagactatgtggactctgtgaaggccattcaccatcncagagacaacgccaaagactcactgtatctgacaaatgaacagacctaagacccgagacacggctgtgtattactgtgcgagacgaccgctacggtcgggggcccggagccccgtggtccccacccgtctccctcacgtcccctacccgaaccgaacgggccccctagttccccggttcccttccccccgngggcccgtccctcgcctccgaggacgccgacccgtccgagacgccgacgacggcccggcccgtcgggggctcggtccgtcgggtaccgaacggtaccttccgttccgtcgtcgacgtcgtcgtaaggcggcgggcgngggacgacggccgangtgnnnnnnnn

SEQ ID NO: 337235 - DNA, 536 bp, Homo sapiens
  misc_feature: GZ8MTXP02II53W.2.28.C06.1.454.CMB.2.raw
  modified_base (522)..(522): a, c, t, g, unknown or other
  misc_feature (522)..(522): n is a, c, g, or t
  modified_base (529)..(536): a, c, t, g, unknown or other
  misc_feature (529)..(536): n is a, c, g, or t
tcagacgctcgacacacgaccggtgctcgatttagagctcacgtattgggtttggtccagcctgggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgccaagaactcactgtatctgcaaatgaaacagcctaagaccccgaggacacggctgtgtattactgtgcgagagacccgctacgtggggccccgggagcccctggtcccacccgtctcctcacgccctcccaccgaacgggccccagtcccggtccttccccctgggcccgcccctgccctccaggacgccacctcccgagacgcacagccggccctgggcctgccctggtcaacggctacttcctgtcgagcgtctgaggcgggctggcaacggccganagtaagnnnnnnnn

SEQ ID NO: 337236 - DNA, 582 bp, Homo sapiens
  misc_feature: GZ8MTXP02GDKL4.2.28.C06.1.454.CMB.2.raw
  modified_base (575)..(582): a, c, t, g, unknown or other
  misc_feature (575)..(582): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaaagaactcactgtatctgacaaaatgaaacagaccctaaagaccccgaggacacggctgtgtattactgtgcgagagacccgctacgtggggcccggagcccctggtcccacccgtctcctcacgcccctccgacccgaaaggggcccccagttcccggtcccttccccccgtgggcccgccccctgccctcccgaaggacgccaccctccggaagacgcaccaggcccgggtccccgtggggcctggcccctggggtaccaaagggtccttaacgttccgtgtcgacgcgttcgtgacggcgggcgtcggcgaacggcgcagtaagnnnnnnnn

SEQ ID NO: 337237 - DNA, 520 bp, Homo sapiens
  misc_feature: GZ8MTXP02HOJOM.2.28.C06.1.454.CMB.2.raw
  modified_base (370)..(370): a, c, t, g, unknown or other
  misc_feature (370)..(370): n is a, c, g, or t
  modified_base (479)..(479): a, c, t, g, unknown or other
  misc_feature (479)..(479): n is a, c, g, or t
  modified_base (513)..(520): a, c, t, g, unknown or other
  misc_feature (513)..(520): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagaccccgaggacacggctgtgtattactgtgcgagagaccgctacgtggggcccggagccccgtggtcccaccgtctcctcagccctccnccaagggcccatccggtccttccccccgtggcccgccctgcctcccaggacgcaccctccgacgacgcacagccggcccgtgggccttgcctggtcaaggacctactcngtcgagcgtctgagcggctggcaggcgcataagnnnnnnnn

SEQ ID NO: 337238 - DNA, 555 bp, Homo sapiens
  misc_feature: GZ8MTXP02HNI02.2.28.C06.1.454.CMB.2.raw
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (548)..(548): a, c, t, g, unknown or other
  misc_feature (548)..(548): n is a, c, g, or t
  modified_base (550)..(555): a, c, t, g, unknown or other
  misc_feature (550)..(555): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaaagaactatgtggactctgtgaagggccgattcaccatctccagagacaacgccaaagaactcactgtatctgcaaaatgaaacagcctaaagaccccgaggacacggctgtgtattacngtgcgagagaccgctaacgtggggccccggagcccctggtcccacccgtctcctcagccctccaccaaagggccccaatccggtccttccccccgnggcccgccctgcctccgaggacnccaccctccgaagacgcacgacgccggcccgtgggctgccgtaggacaaacggtacctacttcctgtcgagtcgtctggacggccgggcgtcggacgaacggacgacgagtaaganannnnnn

SEQ ID NO: 337239 - DNA, 691 bp, Homo sapiens
  misc_feature: GZ8MTXP02HVSK4.2.28.C06.1.454.CMB.2.raw
  modified_base (236)..(236): a, c, t, g, unknown or other
  misc_feature (236)..(236): n is a, c, g, or t
  modified_base (484)..(484): a, c, t, g, unknown or other
  misc_feature (484)..(484): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(686): a, c, t, g, unknown or other
  misc_feature (685)..(686): n is a, c, g, or t
  modified_base (688)..(688): a, c, t, g, unknown or other
  misc_feature (688)..(688): n is a, c, g, or t
  modified_base (690)..(691): a, c, t, g, unknown or other
  misc_feature (690)..(691): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccaggggaagggctggagtgggtggccagcatgaacggagatggaagtacaaaagactatgtggactctgtgaagggccattcacatctccaganacaacgccaagactcactgtatctgacaaatgaaacagacctaaacgaccccggaaggtaccacggtctgtagttaacttacgtggtcgacgaaggacgaccccggtacgtacgggtccgggggacccccgggtacgccccggttaggtccccccacccggttccctaccccctaccgacgtccccccttacccgacccggaacggggtcccccctaaggttcccccggttccccgtttcccccccgngggcccccgtccccgtacgtccccgttacccgagggacccgacccgtaacccgtcccggaagaccgccacgtaccggccggtccccgtaggggcttccggtccgtacggtaaccgtaacggtaccttaccgttccgtggtcccgaagtcccgtcgtacggacggtcgggacgtcggacgaacggcgacgagtaagcncncnncncnn

SEQ ID NO: 337240 - DNA, 576 bp, Homo sapiens
  misc_feature: GZ8MTXP02FGI4S.2.28.C06.1.454.CMB.2.raw
  modified_base (220)..(220): a, c, t, g, unknown or other
  misc_feature (220)..(220): n is a, c, g, or t
  modified_base (566)..(576): a, c, t, g, unknown or other
  misc_feature (566)..(576): n is a, c, g, or t
tcagacgctcgacacacgaccggtgctcgatttagagctcacgtattgggtttgggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccattcaccatcnccagagacaacgccaagaactcactgtatctgcaaatgaacagcctaagacccgaggacacggctgtgtattactgtgcgagagaccgctaacgtggggccccgggagcccgtggtcaccgtctcctccacgcctccaccaaggggcccccagtccggtccttccccctggccgccctgcctccagacgccacccgtccgagacgccacacggcccggtcccctgggggcctcggtacccgtggggttcccaaaaggggtacccttaacccgtttccgtcggttcccggaggtccgtcgtcggaggccggggccttgggacccgaaggggtccgacgaactacgcnnnnnnnnnnn

SEQ ID NO: 337241 - DNA, 543 bp, Homo sapiens
  misc_feature: GZ8MTXP02GFL9N.2.28.C06.1.454.CMB.2.raw
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(543): a, c, t, g, unknown or other
  misc_feature (539)..(543): n is a, c, g, or t
tcagacgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaaagactatgtggactctgtgaagggccgattcaccatctccagagacaacgccaaagaactcactgtatctgacaaatgaaacagacctaagaccccgaggacacggctgtgtattactgtgcgagacgaccgctacgtcggggacccggagccccgtggtccccaccgtcctcctccacgccctacccaccgaacggggccccacgttcccgtcccttcccccnggccgccctcgcctccaggacnccaccnccgagacgcacagccggccnggcncgctggcaagctactcgtgcgagcgtctagcggcgggcgtcggacgaacggcgaccgtaagaagncncnnnnn

SEQ ID NO: 337242 - DNA, 572 bp, Homo sapiens
  misc_feature: GZ8MTXP02FI861.2.28.C06.1.454.CMB.2.raw
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
  modified_base (536)..(536): a, c, t, g, unknown or other
  misc_feature (536)..(536): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (566)..(572): a, c, t, g, unknown or other
  misc_feature (566)..(572): n is a, c, g, or t
tcagacgctcgacacacgaccggtgctcgatttagagctcacgtattgggtttggtccagcctgggggggtccctgagactctcgtgtgcggcctctggattcatctctacaaactattggatgagctgggtccgtcaggctccgagggaggggctgggagtgggtgccagcatggaacggagataggaagtacaaaaaagactatgtggactntggtgaagggccattcaccatcncaganacacgccaagactcactgtatctagacaaatcgaaacacgaccaaacgaccccgaggacacggcttgtcgtatcgtggtgacgagacgaccgcgtacggggtcggggcccggagtccccgttggtaccccctacccgtctaccctcgacgtcccccaacgacggaccgggccctagttcccggtccttcccccggggccctccctgacctcgaggcaccnccgcgacgcgcacgcgccgcgnggctcgccgtacggtacaccggtacttcctcgacgtcgacgtcgcgtacggngcgggtcacggcgacgaccgctanaagngnnnnnnn

SEQ ID NO: 337243 - DNA, 357 bp, Homo sapiens
  misc_feature: GZ8MTXP01DPNI3.11.85.H08.1.454.CMB.2.raw
  modified_base (355)..(357): a, c, t, g, unknown or other
  misc_feature (355)..(357): n is a, c, g, or t
tcagcgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccgtatctctcgctgagcgggctggcaaggcgcatagnnn

SEQ ID NO: 337244 - DNA, 557 bp, Homo sapiens
  misc_feature: GZ8MTXP01EHFDS.11.85.H08.1.454.CMB.2.raw
  modified_base (374)..(374): a, c, t, g, unknown or other
  misc_feature (374)..(374): n is a, c, g, or t
  modified_base (431)..(431): a, c, t, g, unknown or other
  misc_feature (431)..(431): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccacacagagggatcccttactacaaccccgtcactcaagagtcgacttaccatatcactccgacacgtccaggaatcagttcnccctgaaactgaggtccgcattgtcgcggacacagccgttctatttatgtgtcaganatccggggcccataactggctcggccccgtgggcccggaaccctgggtcaccgtctcctcacgccttccgaccaacgggcccattccggtccttcccccgtggcccaccccttcctccgaagaacg

SEQ ID NO: 337245 - DNA, 552 bp, Homo sapiens
  misc_feature: GZ8MTXP01A6GA6.11.85.H08.1.454.CMB.2.raw
  modified_base (371)..(371): a, c, t, g, unknown or other
  misc_feature (371)..(371): n is a, c, g, or t
  modified_base (511)..(511): a, c, t, g, unknown or other
  misc_feature (511)..(511): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagaggatcccttactacaaccccgtcactcaagagtcgacttaccatatcactccgacacgtcagatcagttcnccctgaaactgagtccgtcattgtcgcggacacagccgtctattattgtgtcagagactccggggccataactggctccggcccgtggggcccggacctggtccaccgtctcctcacgcccttccgaccgaacgggcccngttccggtcctcccccgtggcccacccttcctccgaagccg

SEQ ID NO: 337246 - DNA, 554 bp, Homo sapiens
  misc_feature: GZ8MTXP01A5H4V.11.85.H08.1.454.CMB.2.raw
  modified_base (530)..(530): a, c, t, g, unknown or other
  misc_feature (530)..(530): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagaggatcccttactacaacccgtcactcaagagtcgacttaccatatcactccgacacgtccagaatcagttctccctgaaactgagtcgtcattgtcgcggacacagccgtctattacttgtgtcagagatccggggccataactggctcggcccctggggccccgacctggtccaccgtctcctcacgcccttccgaccgaacgggccccattcccggtccttcccccgnggcccacccttcctccgaacgccg

SEQ ID NO: 337247 - DNA, 565 bp, Homo sapiens
  misc_feature: GZ8MTXP01EC70S.11.85.H08.1.454.CMB.2.raw
  modified_base (388)..(388): a, c, t, g, unknown or other
  misc_feature (388)..(388): n is a, c, g, or t
  modified_base (426)..(426): a, c, t, g, unknown or other
  misc_feature (426)..(426): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
  modified_base (556)..(556): a, c, t, g, unknown or other
  misc_feature (556)..(556): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggctttggatccgacagtccccgagggaaggcctggagtggcttggttatgtccacacagaggatcccttactacaacccgtcactcaagcgtcgacttacatatcactccgacacgtccagatcagttctcctagaaactgagtccgtntattcgtcgcggaacacagccgttacttatttagttgngtcagagacgtcccgggaccctataaccgtggctccggccccgtggggaccccggtaccctggtcaccgtcncctacncgcccttcgacgacggcccngttccggtccttccccgcggtccaccccttcnccgaagccg

SEQ ID NO: 337248 - DNA, 554 bp, Homo sapiens
  misc_feature: GZ8MTXP01ERWWK.11.85.H08.1.454.CMB.2.raw
  modified_base (274)..(274): a, c, t, g, unknown or other
  misc_feature (274)..(274): n is a, c, g, or t
  modified_base (386)..(386): a, c, t, g, unknown or other
  misc_feature (386)..(386): n is a, c, g, or t
  modified_base (545)..(545): a, c, t, g, unknown or other
  misc_feature (545)..(545): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccaggaggctggagnggctggttatgtccacacagagggatcccttactacaacccgtcactcaagagtcgacttaccatatcactcgacacgtccagatcagttctccctgaaactgaggtccgtnattgtcgcggacacacgcgtactattatgtgtcagagactccggggaccataactggctccggccccgtggggccccggaaccctcgggtccacccgtctccctcacgcccttcgaccgaacgggcccattccggtcttccccctggcccacccttccnccaacgccg

SEQ ID NO: 337249 - DNA, 577 bp, Homo sapiens
  misc_feature: GZ8MTXP01BMTFS.11.85.H08.1.454.CMB.2.raw
  modified_base (277)..(277): a, c, t, g, unknown or other
  misc_feature (277)..(277): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagnggcttggttatgtccaccacagaggatcccttactacaacccgtcactcaagagtcgacttaccatatcactccgacacgtccaggaatcagttctccctgaaactgacggtccgtcattgtcgcggacacagcccgtctattattgtgtcagagactccggggcccaagtaacctggctccgggcccctgggggccccgggaaccctgggtccaccgtctccctcacgcccttcccaccgtaacgggccccagttcccgggtcccttcccccgtggcccaccccgttcctccgaagccg

SEQ ID NO: 337250 - DNA, 592 bp, Homo sapiens
  misc_feature: GZ8MTXP01EF7F5.11.85.H08.1.454.CMB.2.raw
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (572)..(572): a, c, t, g, unknown or other
  misc_feature (572)..(572): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggctggagnggctggttangtccaccacagagggatcccttactacaaccccgtcactcaagagtcgacttaccatatcactccgacacgtccaggaatcagttctccctgaaactgaggtccgtcattgtcgcggacacagcccgttacttatttattgtgtcagagactcccggggccctaattaaccgtggcctccgggcccccgttgggggaccccgggaacccgtgggtaccaccgtcctaaccgtcacgcccttccgaccgaacgggccccagttccggtcccttccccgtcggacccnccccttcctcccgaacgccg

SEQ ID NO: 337251 - DNA, 357 bp, Homo sapiens
  misc_feature: GZ8MTXP01A59JJ.11.85.H08.1.454.CMB.2.raw
  modified_base (354)..(357): a, c, t, g, unknown or other
  misc_feature (354)..(357): n is a, c, g, or t
tcagcgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccgttgggtttgggggaagaggaagactgacggtcccccaggagttcaggtgctgggcacgagcggccctgggctgcctggtcaaggctactcgtatctctcgctgagcgggctggcaaggcgcatagnnnn

SEQ ID NO: 337252 - DNA, 543 bp, Homo sapiens
  misc_feature: GZ8MTXP01ESJRO.11.85.H08.1.454.CMB.2.raw
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (364)..(364): a, c, t, g, unknown or other
  misc_feature (364)..(364): n is a, c, g, or t
  modified_base (416)..(416): a, c, t, g, unknown or other
  misc_feature (416)..(416): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccagggactggtgaagccttcacagacgctgtccctcacctgcaatgtctccgagtctccatcaccgatactgattactactggctttggatccgacagtcccaggaaggctggagngctggtangtccacacagaggatccctatacaacccgtcactcaagacgtcgacttacatactcactcgacacgtccaggaatcagttcnccctagaaacctgacgtcgtcattgcgacggacacagcccgtatattatgtnttacagagattccggggccactaactacgcgtccgcccgtcgggcccggtaacccgtcgtctccgtcctcctccncgccnccgacgacgccgcttcgtcctcccgtccgccnccncctccgaacgcg

SEQ ID NO: 337253 - DNA, 577 bp, Homo sapiens
  misc_feature: GZ8MTXP01D9A5R.11.85.H08.1.454.CMB.2.raw
  modified_base (277)..(277): a, c, t, g, unknown or other
  misc_feature (277)..(277): n is a, c, g, or t
  modified_base (552)..(552): a, c, t, g, unknown or other
  misc_feature (552)..(552): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagnggcttggttatgtccacacagagggatccccttactacaaccccgtcactcaagagtcgacttaccatatcactccgacacgtccaggaatcagttctccctagaaactgaggtccgtcattgtcgcggacacagccgtctattacttgtgtcagagactcccggggcccaataacctggccgttcccggccccgtgggggaccccggaaccctgggtccaccggtctccctcacgcccttccgaccgaacgggcccattccggtccttcccccnggcccacccttcctccgaagaaccg

SEQ ID NO: 337254 - DNA, 357 bp, Homo sapiens
  misc_feature: GZ8MTXP01AZ4VI.11.85.H08.1.454.CMB.2.raw
  modified_base (353)..(357): a, c, t, g, unknown or other
  misc_feature (353)..(357): n is a, c, g, or t
tcagcgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccgttgggtttgggggaagaggagactgacggtcccccaggagttcaggtgctgggcacagcggccctgggctgcctggtcaaggctactccgtatctctcgctgagcgggctggcaaggcgcatagnnnnn

SEQ ID NO: 337255 - DNA, 636 bp, Homo sapiens
  misc_feature: GZ8MTXP01AKLQH.11.85.H08.1.454.CMB.2.raw
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
  modified_base (452)..(452): a, c, t, g, unknown or other
  misc_feature (452)..(452): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccaggggaaggcctggagtggcttggttatgtccacacagaggactcccttactacaacccgtcactcaagagtcgacttacatatcactccgacacgtcagatcagttccnccctgaaactgaggtccgtnattgtcgcggacacagccgtactattattgtgtcagagactccggggacctaagtaaccnggcctccgggccccgtcgggggacccccgggtaaccctcggggtaccacccggtcctaaccctcgaccggtccccttacccgaaacccgaacggggcccccttaaggtttccccggggtccccttttcccccccggcgggtaccccctacccccgttaccctaaccccgaaacgggtaaccccg

SEQ ID NO: 337256 - DNA, 661 bp, Homo sapiens
  misc_feature: GZ8MTXP01DF43V.11.85.H08.1.454.CMB.2.raw
  modified_base (369)..(369): a, c, t, g, unknown or other
  misc_feature (369)..(369): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcacgatactgattactactggctttggatccgacagtccccagggaaggcctggagtggcttggttatgtccaccacagaggatcccttactacaaccccgtcactcaagagtcgacttaccatactcactcgacacgtcagatcagttcncctagaaactgacgtcgtcattcgtcgcggacacagtcccgtattatttacttgtgttcagaagtcgtcccggggaccctaagttaaccgtgggcccttcccggggcccccgttggggggaccccccgggtaaacccgttcgggtacctaccccggttcctaaccccttcgaaccggtccccttacccgaacccggaaacggggcccccttaaggttcccccgggttcccctttcccccccgtcgggtacccctaccccccgttcccgttaaccccgaaacggtaaccccgg

SEQ ID NO: 337257 - DNA, 631 bp, Homo sapiens
  misc_feature: GZ8MTXP01D0Z0Z.11.85.H08.1.454.CMB.2.raw
  modified_base (329)..(329): a, c, t, g, unknown or other
  misc_feature (329)..(329): n is a, c, g, or t
  modified_base (602)..(602): a, c, t, g, unknown or other
  misc_feature (602)..(602): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaaggcctggagtggcttggttatgtccacacagaggatcccttacacaacccgtcactcaagngtcgacttaccatatcactccgacacgtcaggaatcattctccctagaaactgacggtccgtactattcgtcgacggacacacgtcccgttattaattattgtcgtcaaggtaacgacgttccccgggggacccctaagtaaaccgttcgggccttcccgggcccccgttcgggggacccccgggtaacccttcgggtacctacccggtcctaacccgtcacggcccttaccgaacccgaacgggccccagttcccggtaaccctttccccgnggcccctacccgttcctccgaaacggccg

SEQ ID NO: 337258 - DNA, 629 bp, Homo sapiens
  misc_feature: GZ8MTXP01ER0FT.11.85.H08.1.454.CMB.2.raw
  modified_base (322)..(322): a, c, t, g, unknown or other
  misc_feature (322)..(322): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtctccatcaccgatactgattactactggctttggatccgacagtccccagggaaggcctggagtggcttggttatgtccaccacagaggactcccttactacaacccgtnactcaagagtcgacttacatatcactccgacacgtccaggatcagttcctccctagaaactcgaacggttccgtactattcgtcgaccggacacgacgtccgttacttatttatgtagtacaagtaagacgttccccgggggaccctaagtaaccgtcgggcctcccgggcccccggtgggggacccccgggtaacccgtggggtaccctaccccggtcttccctcgacgcccttaccgaacccgaacgggccccttacgttccggtcccctccccgtcggccctccccttactaacccgaaggccc

SEQ ID NO: 337259 - DNA, 681 bp, Homo sapiens
  misc_feature: GZ8MTXP01BKG2Q.11.85.H08.1.454.CMB.2.raw
  modified_base (387)..(387): a, c, t, g, unknown or other
  misc_feature (387)..(387): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtctccatcaccgatactgattactactggtctttggatccgacacgtccccgagggaggctggagtggcttggttatgtccacacagaggactccctaactacaacccgtcactacaagacgtcgacttacatatcactccgacacgtcagatcattctcctagaactgacgtctntattgtcgacggtacacgacgtccgttacttagtttattgtcgttacgagtagtaccgtccggggaccctaagttaaaccgtcgggtccgtccccgggcccccggttacgggggaccccccgggtaacccgttccgggtacccgtacccggttcccttaacccgccgttaccggcccccttacccgaaaccccggtaaaccggggcccccttaacggttccccggtttcccccgttccccccgtcgggtaccccctacccccgtttccccgtaacccgaaaccgggtaaccccg

SEQ ID NO: 337260 - DNA, 705 bp, Homo sapiens
  misc_feature: GZ8MTXP01B6I3K.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcaccgatactgattactactggtctttggatccgacacgtccccgaggggaaggcctggagtggcttggttatgtacccaccacgaggacgggtactaccccttactaaccaaccccgtcaactacaagtacgtacgtaacttaccatactcaccgtacccgaaccacgtaccgaaggtaactactacgttcctaccctagaaaccgtggacggtccgtctatttcgcgaccggaacacgagtcccgttacttagtttattgtgtactaaggacgtaccgtccccggggacctaaattaaccggtcggacccgtcccgggcccccggttacgggggacccccgggtaacccgttcggggtaccctacccgggttccctccctccgaccggtcccccttacccgaaaccggtaaccgggccccttacgttccccgggtttcccttcccccgtcgggcccctaccccgttaccctaaccgaaacggcccg

SEQ ID NO: 337261 - DNA, 617 bp, Homo sapiens
  misc_feature: GZ8MTXP01EFZD8.11.85.H08.1.454.CMB.2.raw
  modified_base (349)..(349): a, c, t, g, unknown or other
  misc_feature (349)..(349): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacagtccccgagggaaggcctggagtggcttggttatgtccaccacagagggatcccttactaccaacccgtcactcaagagtcgacttaccatancactccgacacgtcaggatcagttctcctgaaactgacgtccgtcattgtcgcggacacacgtccgtactattattgtgtcagagactccggggaccctaataacgtcggacccgtcccggccccggtcggggaccccggaaccgttcggtcctacccggtcctccctcgaccgtcccttaccgaaccgaaccgggccccttacgttccccgggttcccttcccccgtcggtccccacccccttcccgtaacccgttaaagaaccccg

SEQ ID NO: 337262 - DNA, 582 bp, Homo sapiens
  misc_feature: GZ8MTXP01CIR0K.11.85.H08.1.454.CMB.2.raw
  modified_base (497)..(497): a, c, t, g, unknown or other
  misc_feature (497)..(497): n is a, c, g, or t
  modified_base (534)..(534): a, c, t, g, unknown or other
  misc_feature (534)..(534): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccaggggaggcctggagtggcttggttatgtccaccacagaggactcccttacacaacccgtcactcaagagtcgacttaccatatcactcccgacacgtccaggaactctagttcctccctagaaactgacgtcgtcattgtcgcggacacagccgtctattattgcttcagagactccggggcctaagtaacgtggcctccgggccccgtcgggggaccccggaccctgggtccncccgtctccctcacgcccttccgaaccgacgggcccngttccggtccctcccccgtcgccctaccccttcctaaccgaacgtccg

SEQ ID NO: 337263 - DNA, 363 bp, Homo sapiens
  misc_feature: GZ8MTXP01APFEE.11.85.H08.1.454.CMB.2.raw
  modified_base (357)..(363): a, c, t, g, unknown or other
  misc_feature (357)..(363): n is a, c, g, or t
tcagcgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccggagatcatgagggtgtccgttgggtttgggggaagaggaagactgaccggtcccccaggagttcaggtgcgtgggcacagcggcctgggctgcctggtcaaggactactccgtatctctcgctgagcgggctggcaaggcgccatagnnnnnnn

SEQ ID NO: 337264 - DNA, 694 bp, Homo sapiens
  misc_feature: GZ8MTXP01BGIL0.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggctttggatccgacagtccccgagggaagggcctggagtggcttggttatgtccacacagaggatccctactaccaacccgtcactcaagagtcgacttacatatcactccgacacgtccaaggactcagttctccctagaaactgacgtccgtactattcgtcgcggacacgacgccgttacttattattgtgttcagacgacttcccgggggaccctaagttaaccgtcgggccttcccggggcccccgttacggggggaccccccgggtaaaccccgtcggggtccccaacccgggttccctcccgttccgaccggtccccttaccccgaaaccccggtaaaccgggggccccccttaaacggtttcccccggggttccccttttcccccccccggtcgggtaccccctacccccccgtttaccccttaaccccgaaaacggtaaccccggg

SEQ ID NO: 337265 - DNA, 608 bp, Homo sapiens
  misc_feature: GZ8MTXP01DRPX1.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccacacagaggatcccttactacaaccccgtcactcaagagtcgacttacatatcactccgacacgtccagatcagttctcctgaaactgacgtcgtcattgtcgcggacacagtccgtactattattgtgtacagagactccggggccctaattaaccgtggacctcccgggccccgtcgggggaccccgggtaaccgtcgggtcccacccggttcctcccgtcgacgtccccttcccgaacccgtaacggggccccttagttccccgggttcccttcccccgtggccccaccccttccctaaccgaacgtaacccg

SEQ ID NO: 337266 - DNA, 654 bp, Homo sapiens
  misc_feature: GZ8MTXP01DRW5I.11.85.H08.1.454.CMB.2.raw
  modified_base (460)..(460): a, c, t, g, unknown or other
  misc_feature (460)..(460): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaaccgatactgattactactggtctttggatccgacacgtcccgaaggggaacggcctggacgtggtcttggttatcgtaccacacagaggactccctactaccaaccgtcactacaagagtacgtaacttaccatactacactccgacacgtaccaaggaactcaagttcctaccctaagaaacgttgaacggtccgtactattgtcgacggaacacacgtccgttactaatttattgtntacagtaagtacgtcccggggaccctaagtaaccgtcggccgtcccgggccccgtccgggggacccccggtaacctccgggtacctacccgtcctcccttcgaccgtcccttacccgaccgaaaccgggccccttaggttccccgtccctttcccccgcgcccctaccccttccctaacccgaacggtaacccg

SEQ ID NO: 337267 - DNA, 710 bp, Homo sapiens
  misc_feature: GZ8MTXP01C6X6C.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgaggggaacgggcctggagtggtcgttggttatcgtccaccacgaggacgggtactccccttactaaccaaccccgtcactacaaagacgtcgaacttaccatactcactccgacacgtcaagactacagttcctccctagaaactgacgtccgtctatcgtcgcggacacagtccgtacttagttacttgtgtacagtaacgacgttcccggggaccctaagtaaccgtcgggtccgtccccgggccccggttcgggggaccccgggtaacccgttcggtaccctacccggtccctcccgttccgaccgtccccgttaccccgaaacccgggtaaacccggggttcccccttaggttcccccggggtttccccttccccccccggttgggtaccccccttaaccccccggttcccctttaacccgaaaacccgggtaaaccccggg

SEQ ID NO: 337268 - DNA, 579 bp, Homo sapiens
  misc_feature: GZ8MTXP01DFDCD.11.85.H08.1.454.CMB.2.raw
  modified_base (276)..(276): a, c, t, g, unknown or other
  misc_feature (276)..(276): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaggcctggagnggcttggtatgtccacacagaggatcccttactacaacccgtcactcaagagtcgacttacatatcactccgacacgtccagaatcagttcctaccctagaaactgacggtccgtacattgtcgcggacacgacgccgtacttattattgtgttcagagactccggggacccaataaccgtggcctccggccccgtgggggccccggaaccgtggtcccaccgtctccctcacgcccttccgaccgaacggcccttagttcccggttcctccccctggccccacccgttcctcccaaggcccg

SEQ ID NO: 337269 - DNA, 680 bp, Homo sapiens
  misc_feature: GZ8MTXP01DXKCO.11.85.H08.1.454.CMB.2.raw
  modified_base (396)..(396): a, c, t, g, unknown or other
  misc_feature (396)..(396): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccagggaagggcctggagtggcttggttatgtccaccacagaggatcccttactacaaccccgtcactcaagagtcgacttacatatcactccgacacgtcaggaatcagttctcctagaaactgacggtccgtnattggtcgcggacacgagccgttacttatttattcgtgtccaaggtacgacgttccccgggggaccctaagttaaaccgtcgggcccttccccggggcccccgttggggggaccccccggggtaaaccccttcgggggtacccctacccggttcctccccgttcgaaccggtccccttacccggaaacccgaaccgggggttacccccttacgttccccgggttccccttttccccccgcgggtcccccaacccccgttcccttaacccgaaaacgggtccccg

SEQ ID NO: 337270 - DNA, 588 bp, Homo sapiens
  misc_feature: GZ8MTXP01B1JNG.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggtatgtccaccacagagggatcccgttactacaacccgtcactcaagatcgacttaccatatcactccgacacgtccaggatacagttcctccctgaaactgacggtcgtcattgtcgcggacacgagccgtctattattgtgtcagagacgttccggggcctataacctcgggccttccggccccgtcggggaccccggaacccgtcggtccacccgtctccctcgacgccttccgacccgaacgggccccagttcccggtcttcccccgtcggccctacccgttccctccgttaacgaacccg

SEQ ID NO: 337271 - DNA, 644 bp, Homo sapiens
  misc_feature: GZ8MTXP01AU08K.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgagggaagggcctggagtggcttggttatgtccaccacgagaggactcccttactacaacccgtcactcaagagtcgacttacatatcactccgacacgtcagatcacgttctcctagaaactgacggtctctattcgtcgcggacacgacgtccgtacttattattgtgtacgaagacgacgtcccggggaccctaagtaaccgtcgggcctcccgggccccggttaccggggggacccccggtaacccgttcgggtaccctacccggtccctccgtccgaccggtccccttacccgaacccgaaccggggccccttacggttcccgggttccccttcccccgtcggcccctaccccttccctaacccgaacggaacccg

SEQ ID NO: 337272 - DNA, 559 bp, Homo sapiens
  misc_feature: GZ8MTXP01CWE7C.11.85.H08.1.454.CMB.2.raw
  modified_base (277)..(277): a, c, t, g, unknown or other
  misc_feature (277)..(277): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
  modified_base (536)..(536): a, c, t, g, unknown or other
  misc_feature (536)..(536): n is a, c, g, or t
tcagcgagagataccacgaccggtgctcgatttagtatcactcagtcggcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggctttggatccgacagtccccagggaaggcctggagngcttggtatgtccacacagaggatccctactacaacccgtcactcaagatcgacttaccatatcactccgacacgtccaggaatcagttctccctagaaactgagtccgtnatttgcgcggacacagcccgtntattatgtgtcagagattccggggccctataacctgggctccgggcccctggggaccccggtaacctggtccaccgtctccgtcacgtccttccgaacgaacgggccccattccggtccttccccnggtcccacccttctccgaagccg

SEQ ID NO: 337273 - DNA, 616 bp, Homo sapiens
  misc_feature: GZ8MTXP01EWKXF.11.85.H08.1.454.CMB.2.raw
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaggcctggagnggcttggttatgtccacacagaggatccccttactacaacccgtcactcaagagtcgacttaccatatcactccgacacgtccaggaatcagttctccctgaaactggacgtcgntattcgtcgcggacacgacgtccgttactatttagttgtcgtacagacgtacgttcccggggacctaagtaaccgtcggtccgtcccggccccggtcgggggaccccggtaaccgtcggtaccctacccgtcctcctacgccgtcccttaccgaaccgaaccgggcccttacgttcccggttcccttccccgtcggcccctaccccttcctaaccgaacgtcccg

SEQ ID NO: 337274 - DNA, 650 bp, Homo sapiens
  misc_feature: GZ8MTXP01BCLH5.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtctcatcaccgatactgattactactggtctttggatccgacacgtccccgaggggaagggcctggagtggtcttggttatgtccaccacgagaggactaccctactaccaacccgtcactcaagagtcgacttacatactcactccgacacgtccaaggaatcagttctaccctagaaactggacggtccgtactagttgtcgcggtacacgagtccgtctatttattgtgttcagagaccgttccggggacctagtaacctcgggtaccgtcccggccccgtacgggggccccggtaacccgtcggtacccgtaccggtcctcccgtccacggtccccttacccgaaccggaaccggggttccccttacggttccccggttcccctttccccccgtcgggcccctaccccttccccgtaacccgaacgtaaccccgg

SEQ ID NO: 337275 - DNA, 648 bp, Homo sapiens
  misc_feature: GZ8MTXP01CC6PK.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggctttggatccgacagtccccagggaaggcctggagtggcttggttatgtccacacagaggatccctactacaacccgtcactcaagagtcgacttaccatatcactccgacagtccagaatcagttctccctagaaacctgacgtccgtacattgtcgcggacacagtccgtactattattgtgtcagagactccggggaccctataaacgtcggtccgtccggccccgttggggacccccgggtaacccgtcgggtaccctacccgggtcctcccgttccgaacggtccccttaccccgtaacccgtaaaccgggggcccccttaacggttccccggttccccgttccccccccgttggggcccctaaccccccggttccctaacccccgttaaacggtaaccccgg

SEQ ID NO: 337276 - DNA, 734 bp, Homo sapiens
  misc_feature: GZ8MTXP01CG4KU.11.85.H08.1.454.CMB.2.raw
  modified_base (300)..(300): a, c, t, g, unknown or other
  misc_feature (300)..(300): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggatctcatcaccgatactgattactactggtctttggactccgacacgtccccgaggggaacggcctggagtggtcttggtatcgtccacanagaggactcccttaacacaacccgtcactacaagtacgtacgtacttacatactcactcccgacacgtaccaaggtaactactacgtttcctacccgttaagaaaaccgttcggtacggtccgtactaagtttcggaccgacggaacctacgacgtcccgttatttaagtttagttcggtacgttacaaggtacgtaacgttcccgggggaaccctaagtaaccgtcgggacccttccccggggccccggttcgggggacccccgggtaaccctccggggtaccctacccgggttccctaaccctaccgaccgtccccacccgaaaccccggtaaccggggttcccccttaacggttccccgggtttcccccgttcccccccgttggggacccccctacccccgttccccgttaaaccgaaccggtaaccccgg

SEQ ID NO: 337277 - DNA, 647 bp, Homo sapiens
  misc_feature: GZ8MTXP01DMRSR.11.85.H08.1.454.CMB.2.raw
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
tcagcgagagataccacgaccggtgctcgatttagtatcactcagtcggcggggtcctggacctcctgtgcaagaccactgaaacacctgttgttcttcctcctgctggtggcagctcccaaatgggttcctgtcccaggtacacctggtggagacgggcccaggactggtgaagccttcacagacgctgtccctcacctgcaatgtctccggagtctcatcacgatactgattactactggactttggatccgacagtcccaggaggctggagnggcttggtancgtcacacagaggatcccgtatacaacccgtnactacaagacgtcactttaccatactcacgtccgacacgtccaaggtaactcacgttcnccctagaaaaccttgaacgggtccctanacgtttgcgacggacaactcgcccttatatttattggtgtcgagacggtacttccgggggacccaagtaaccgtggccttccggccccgttgggggaccccggtaacccttggggtacccacccgggtcttcccgtaacgcggtaccccttccctaccgtaaccggttacccgaccgttaccggttcccgttaccccgttcccgggtcccgaaccccgttcccgtaacccaaccggtaacccg

SEQ ID NO: 337278 - DNA, 610 bp, Homo sapiens
  misc_feature: GZ8MTXP01AXX4G.11.85.H08.1.454.CMB.2.raw
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (430)..(430): a, c, t, g, unknown or other
  misc_feature (430)..(430): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgttcctcacctgcaatgtctccggagtctccatcaccgatactgattactactggtctttggatccgacacgtccccgagggaaggcctggagtggcttggtatgtccacacagaggactccctactacaacccgtcacncaagcgtcgacttaccatatcactaccgacacgtccaggaactcacgttcctaccctagaaactggacgtccgtnattcgcgcggacacagccgtcttaatttnttgtgttacgagagtacgtcccggggacctaattaaccgtcggaccgttcccgggcccccggttcgggggaccccgggtaacccgtcggtcctacccgtcgtccctcgacgcccttaccgaccgaacggcccttacgttccggtccctccccgtcgcccacccttcctaaccgaacgccg

SEQ ID NO: 337279 - DNA, 721 bp, Homo sapiens
  misc_feature: GZ8MTXP01DUP6Z.11.85.H08.1.454.CMB.2.raw
  modified_base (376)..(376): a, c, t, g, unknown or other
  misc_feature (376)..(376): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagcctccacagacgctgtccctcacctacaatgtctccggagtctccatcaccgatactgattactactggtctttggatccgacacgtccccgagggaacggcctggagtggcttggtatcgtccacacagaggactcccttacaccaaccgtcactcaagagtacacttacatactcactcgaccacgtcaggaatcaagttcncctagaaactgacggtcctactattcgtcgacggacacgacgccgttcttaatttagttgttcgtaccgaagaacggtacgttaccccgggacccctaaagtttaaaccggtcggggaccccgtttcccgggggacccccccggttccggggggggtaccccccgggtaaaccccggtttcggggtaccccgtaaccccgggtttccctaccccggttccgaaccggttccccgttaccccgaacccggaaaacccgggggtccccttaacgttcccggggttaccccttccccccggttcggcccctaaccccctcccgttacccgaaacggccgtaaccccgg

SEQ ID NO: 337280 - DNA, 634 bp, Homo sapiens
  misc_feature: GZ8MTXP01CIAW9.11.85.H08.1.454.CMB.2.raw
  modified_base (371)..(371): a, c, t, g, unknown or other
  misc_feature (371)..(371): n is a, c, g, or t
  modified_base (422)..(422): a, c, t, g, unknown or other
  misc_feature (422)..(422): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcacgatactgattactactggctttggatccgacacgtccccagggaaggcctggagtggcttggttatgtccacacagaggatcccttactacaacccgtcactcaagagtcgacttaccatatcactccacacgtccaggaatcagttcnccctagaaactgacggtctctattcgtcgcggacacagtcgtcttaatttnttgtcgtactagagtactccggggaccctaattaacgtcgggcctacccgggccccgtcgggggaccccgggtaacccgtcggtcccacccggtcctccctcgccggtcccttacccgaaacccgaacggggttcccccttacgttcccgggttcccctttccccccgtcggggtcccctacccccttcccgtaacccgaacggtaaccccg

SEQ ID NO: 337281 - DNA, 617 bp, Homo sapiens
  misc_feature: GZ8MTXP01DPBOL.11.85.H08.1.454.CMB.2.raw
  modified_base (327)..(327): a, c, t, g, unknown or other
  misc_feature (327)..(327): n is a, c, g, or t
  modified_base (401)..(401): a, c, t, g, unknown or other
  misc_feature (401)..(401): n is a, c, g, or t
  modified_base (439)..(439): a, c, t, g, unknown or other
  misc_feature (439)..(439): n is a, c, g, or t
  modified_base (535)..(535): a, c, t, g, unknown or other
  misc_feature (535)..(535): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctcggatctcatcacgatactgattactacgtggtctttggatccgacacgtcccgagggacggcctggagtggtcttggttatcgtaccacacgaggacggactccctactacaacccgtnactacgaagacgtcgacttaccatactcactcacacgtcagtaactcagttccacctagaaactggacgtcctntagttcgtcgacggtacacgacgtccgttattaatttntggtcgtacagacgtactcccggggacctaagtaccgtcgccgtcccggcccggtcgggggaccccgaacctcgggtaccctaccgtctcccgtcncggcccttaccgaaccgacgggttccccttacgttcccggttccccttcccgcggccctaccccgttaccaacgaacgtccg

SEQ ID NO: 337282 - DNA, 652 bp, Homo sapiens
  misc_feature: GZ8MTXP01DYTKK.11.85.H08.1.454.CMB.2.raw
  modified_base (351)..(351): a, c, t, g, unknown or other
  misc_feature (351)..(351): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaaggcctggagtggcttggttatcggtccaccacgagaggactcccttactaccaacccgtcactcaagcgtcgacttacatacncactcgacacgtcagatcagttctcctgaaactgaggtccgtatattcgtcgcggacacgtacgtcccgttacttattacgttgtcgttacagtagtacgtcccgggggaccctaagttaacctcggccgtcccgggccccgtcgggggacccccggtaacccgttggtacccgtacccggttcctcccgttcgacggtccccttcccgaaacccgtacggggcccccttacgttcccgggttaacccctttcccccgtaacgggcccctaccccgttacccgtaacccgaacgtaacccg

SEQ ID NO: 337283 - DNA, 568 bp, Homo sapiens
  misc_feature: GZ8MTXP01D7F0G.11.85.H08.1.454.CMB.2.raw
  modified_base (346)..(346): a, c, t, g, unknown or other
  misc_feature (346)..(346): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (528)..(528): a, c, t, g, unknown or other
  misc_feature (528)..(528): n is a, c, g, or t
  modified_base (545)..(545): a, c, t, g, unknown or other
  misc_feature (545)..(545): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagagggatccctactacaacccgtcaactcaagagtcgacttaccatancactccgacacgtccagaatcagttctccctgaaactgagtccgtnattgtcgcggacacagcccgttactatttattcgtntcagagactccgggggccctataaccgtggctccgggccccgttgggggaccccggaacctggtccaccgtctcctcacgccttccgaccgaagggcccngttccggtcttccccgnggccacccttccgtccaagtccg

SEQ ID NO: 337284 - DNA, 627 bp, Homo sapiens
  misc_feature: GZ8MTXP01BD6HG.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcacgatactgattactactggctttggatccgacacgtccccgagggaacggcctggagtggcttggttatgtccaccacagaggactcccttactacacccgtcactcaagagtcgacttaccatatcactccgacacgtccagactcagttcctccctagaaactgacggtccgtctattgtcgcggacacgacgccgttactatttacttgtcgtcaagagtactcccggggaccctaagtaacctcgggaccctccgggacccccggttcgggggacccccgggtacccgttcgggtccctacccggtcctcctcgaccgtccccttaccgacccgaacgggccccacgttcccggtcccttcccccgtcggcccctaccccgttcctaacccgaacgtaaccg

SEQ ID NO: 337285 - DNA, 714 bp, Homo sapiens
  misc_feature: GZ8MTXP01ANKJU.11.85.H08.1.454.CMB.2.raw
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcaccgatactgattactactggtctttggatccgacacgtccccgagggaacggcctggagtggcttggttatgtccaccanagaggactcccttactacaacccgtcactcaagagtcgacttaccatacncactccgacacgtcagatcagttcncctagaaactgacgtccgtnattgtcgacggacacgacgtccgtacttatttattgtacgttcaagacgtacgttcccgggggaccctaagtaaccgtcgggtacccgtcccggggtcccccgtacggggggtaccccccgggaaaccccgttcgggggtacccctaaccccgggttcccttaaccccgttccggaaaccggttcccccttaccccgaaaccccgggaaaccgggggttccccccttaaacggtttccccgggtttcccccgtttccccccccggtggggtacccccctacccccgtttaccccgttaaccccggaaaacggtcccccgg

SEQ ID NO: 337286 - DNA, 613 bp, Homo sapiens
  misc_feature: GZ8MTXP01ETU9Z.11.85.H08.1.454.CMB.2.raw
  modified_base (397)..(397): a, c, t, g, unknown or other
  misc_feature (397)..(397): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccaggggaagggcctggagtggcttggttatgtccacacagaggactcccttactaccaacccgtcaactcaagacgtcgacttacatatcactccgacacgtcagaatcagttcctccctagaaactgaggtcctntattgtcgcggacacagtccgttactattattgtgtcagagctccggggaccctagtaaccgcggaccgtcccggccccgtcgggggaccccgaacccgtgggtccctacccgtctaacctcacggtcccttacccgaaccgtaacgggccccttagttcccgggttaacccttcccccgtcggccctaccccgttcctaacccgaaggtaacccg

SEQ ID NO: 337287 - DNA, 614 bp, Homo sapiens
  misc_feature: GZ8MTXP01ESDHR.11.85.H08.1.454.CMB.2.raw
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (590)..(590): a, c, t, g, unknown or other
  misc_feature (590)..(590): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggtctttggatccgacacgtccccgaggggaaggcctggagtggcttggttatgtccacacagaggactccctactacaacccgtnactcaagngtacgacttaccatatcactccgacacgtccaagactcagttcctacctagaaactgaggtacctctattcgcgcggacacagtccgttctaatttattgtagttcagaacgtcgtcccggggaccctaattaaccgtgggcccttcccgggccccgttcggggggaccccgggtaacccttcgggtccctacccggtcctccctcgacgccccttaccgaacccgaacgggccccttgttcccggtcccttccccgngtcccaccccttctcccgaagccg

SEQ ID NO: 337288 - DNA, 681 bp, Homo sapiens
  misc_feature: GZ8MTXP01ASBK4.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggtctttggatccgacacgtccccgagggacggcctggagtggcttggttatcgtccaccacgagacggactccccttactaccaacccgtcactacaagagtcgtacttaccatactcactccgacacgtccagaatacacgttcctcctagaaactggacggtccgtctattcgtcgacggacacgacgtccgttactatttattggtgtacaggtacgtacgtcccggggacctaagttaaccgtcgggtccgtccccggggccccggtaccggggggtacccccggggtaaacccgttcgggtaccccgtacccggttccccgtcccgttaccgaccggtccccttacccgaacccgtaaaccggggcccccttacggttccccggttcccttccccccgtcgggccctacccccgttcctaacccgaacggtaacccg

SEQ ID NO: 337289 - DNA, 694 bp, Homo sapiens
  misc_feature: GZ8MTXP01ENU24.11.85.H08.1.454.CMB.2.raw
  modified_base (295)..(295): a, c, t, g, unknown or other
  misc_feature (295)..(295): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggctttggatccgacagtccccagggaggcctggagtggcttggttatgtccaccanagaggatcccttacaccaacccgtcactcaagacgtcgacttaccatatcactccgacacgtccagatacagttctccctagaactgagttccgtcattcgtcgcggacacagccgtacttattactgtagtcagagacgttacccgggggccctaagttaacctcgggaccgttcccggggcccccgttcggggggacccccggggtaaaccccgttcggggttacccaaccccgggtttcccgtccccttcccgaaccggtccccttaccccgaaaccccggtaaaccgggggccccccttaaacggttcccccggggtttccccttcccccccccggtttggggacccccctaaaccccccgttccccttaaccccgttaaaaccggtaaccccgg

SEQ ID NO: 337290 - DNA, 704 bp, Homo sapiens
  misc_feature: GZ8MTXP01C9Y9K.11.85.H08.1.454.CMB.2.raw
  modified_base (390)..(390): a, c, t, g, unknown or other
  misc_feature (390)..(390): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagaggactcccttactaccaaccccgtcactcagagtcgacttacatatcactccgacacgtcagatcagttctcctagaaactgacgtcgtntagttcgtcgcggacacgagtccgtacttattattggtgttacgagtaagtacgttcccggggacccctaagttaaaccgtcgggtacccgtcccggggtcccccggtccggggggtacccccggggtaaaccccgttccgggttcccgtaaccccgggttcccttaaccccgtacgacccggtacccccttacccggaaaccccgtaaccgggggttacccccttaacggtttccccggggttcccccttttaccccccggcggggtaccccctacccccggttacccctaaccccggaaacgggtaaccccg

SEQ ID NO: 337291 - DNA, 626 bp, Homo sapiens
  misc_feature: GZ8MTXP01EHEQ9.11.85.H08.1.454.CMB.2.raw
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtctccatcaccgatactgattactactggtctttggatccgacacgtccccgaggggaaggcctgggagtggcttggttatgtccaccacgagagggtactcccttactaccaaccccgtcaactctaagacgttacgacttaccatactcactaccgactacgtcaggactcacgttccnccctagaaactggtacggtccgtntattgtctcggacncagccgttactattattgtncagagacgtcggggcccagtaacncggacgtccggcccgtcgggggaccccggtaaccgtcggtcccacccggttcctaacctccgacggccccttccgaacccgtaaccgggcccttaccggttccggttccccttccccgtcggccctccccgttactaaccccgaagaacccg

SEQ ID NO: 337292 - DNA, 635 bp, Homo sapiens
  misc_feature: GZ8MTXP01DQIGJ.11.85.H08.1.454.CMB.2.raw
  modified_base (316)..(316): a, c, t, g, unknown or other
  misc_feature (316)..(316): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcacgatactgattactactggctttgatccgacacgtcccgagggaaggcctggagtggcttggtatgtccacacgagaggactcctaacacaaccgtnactacaagacgtacgacttacatactcactccgacacgtccaagactcagttcctacccgtagaaactgaacggtcctactattcggtacgcggaacacgacgtcccgttacttaatttagtgttacgcagacgtacgtcccgggactaagttaaaccgtcggtcccttccggggcccccgttaggggggacccccgggtaaccgttcggtaccctacccggttcctcccgtcgaaccgtcccttacccgaaccgtaacgggccccttagttcccggttcctacccccgtgaccctacccctttccaaccgaagaaccg

SEQ ID NO: 337293 - DNA, 635 bp, Homo sapiens
  misc_feature: GZ8MTXP01DRAH2.11.85.H08.1.454.CMB.2.raw
  modified_base (398)..(398): a, c, t, g, unknown or other
  misc_feature (398)..(398): n is a, c, g, or t
  modified_base (466)..(466): a, c, t, g, unknown or other
  misc_feature (466)..(466): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcacgatactgtattactactggtctttggatccgacacgtccccgagggaggctggagtggcttggttatgtccaccacagaggactcccttaactacaaccccgtcactacagagtcgacttaccatatcactccgacacgtccagaatacagttctccctagaaactgacgtccgtnattcgcgacggacacgagtcccgtattatttatgtgtacagagtactccgggggacccaagttaaccngggtccctcccgggccccgttgggggacccccgggtaaccctcggggtaccacccggttctcccctcgacgtcccccttaccaaacccggtacggggaccccttagttccccggttcccgtttcccccctgggacccccctcccgttacccctaacgaaacgtccccgg

SEQ ID NO: 337294 - DNA, 695 bp, Homo sapiens
  misc_feature: GZ8MTXP01ELLGJ.11.85.H08.1.454.CMB.2.raw
  modified_base (284)..(284): a, c, t, g, unknown or other
  misc_feature (284)..(284): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtcccagggaggctggagtggcttgtangtccacacagaggatccctactaccaacccgtcactcaagacgtcgacttaccatatcactcgacacgtccagatcagttctccctagaaactgacgtccgtacagttcgtacgcggtaacacgagtcccgtacttatttaacttgtgtcaagtacgacgttcccggggacctaagtaaacctcggccgtcccgggtcccccgttccgggggaccccggggtaaacccccgttcgggggtacccctaaccccgggttcccttcccgttcccgaccggtcccccttaccccgaaaccccggaaaaccgggggccccccttaacggttccccggggtttccccctttccccccccggttgggaacccccccgtcccccctttacccgtaacccccgttaaaacggtcccccgg

SEQ ID NO: 337295 - DNA, 672 bp, Homo sapiens
  misc_feature: GZ8MTXP01EPIDG.11.85.H08.1.454.CMB.2.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (402)..(402): a, c, t, g, unknown or other
  misc_feature (402)..(402): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggatctccatcacgatactgtattactactggtctttggactccgacacgtcccgagggaggctggagtggtcttggttangtccacanaggaggactccctacacacccgtcactacgaagacgtacgtactacatactacactccgaacacgtacgagaactcagttccaccgtagaaactcgacggttcctntatttcgcgcggacacgcgtaccgtttacttatttactgtacgttacgaagtacgtaccgtacccgggggaccctaagttaaccgtcgggtacccgtcccgggaccccggtccgggggaccccggtaaccgtcgggtccctacccggttcctccgtaccgaccggtaccccttccgaaacccggtaccgggggttccccttacggttccccgggttccccttcccccggtcgggacccctaccccgttcctaacccgttaacggtccccg

SEQ ID NO: 337296 - DNA, 672 bp, Homo sapiens
  misc_feature: GZ8MTXP01B1WNN.11.85.H08.1.454.CMB.2.raw
  modified_base (403)..(403): a, c, t, g, unknown or other
  misc_feature (403)..(403): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatccacgatactgattactactggtctttggatccgacacgtccccgagggaacggcctggaggtggctttggttatcgtccaccagagaggactccccttacaccaaccccgtcactcgaagacgtacgacttaccatatcactcgacacgtcagatcagttctcctagaaactgacggtccgtntattgcgcggaacacgaacgtcccgtacttattagttagtgttcgaagacgtaacgttcccggggaccctaagttaaccgtgggtccctccccggggcccccgtcggggggtacccccgggtaacccgttcggtcccgaacccgttcctaaccccgtcgacccgtccccgttcccgaaaccccgtaacggggcccccacggtttccccgggttcccccttccccccggtaaggccccctaacccccttcccgtcccgaaaaggtccccg

SEQ ID NO: 337297 - DNA, 765 bp, Homo sapiens
  misc_feature: GZ8MTXP01AR5H4.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgtattactactggtctttggatccgacacgtccccgagggaacggcgtggagtggtcgttggttatcgtccaccacgaggaggactcccttactaccaacccgtcactcaagacgtacgacttaccatactcactccgactacgtccaaggaactactacgttcctacccgtagtaaaccgtgtaccggttcccgtactacgttcggtcgaccggtaacacgtacggtcccgttacttaagtttaacttggtcgtaccgtaaggtaacgtaccgttaccccggggggaacccctaaggttaaacccggtcgggtaccccggttccccggggtccccccggggttaccggggggaaccccccgggtaaaccccgttcccggggtaccccgtaaccccggttcccgtccccgtccgaacccgggtcccccttacccgaaaccccggtaaccggggcccccttacggttccccgggttaacccccttcccccggtaacggtccccctaaccccgttccccgtaaccgaaccgtaacccg

SEQ ID NO: 337298 - DNA, 702 bp, Homo sapiens
  misc_feature: GZ8MTXP01A3QOX.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgtattactacgtggtctttggactccgacacgtccccgagggaagggcctggagtggcttggttatgtccacacagagggactccctactaccaacccgtcactacaagacgtcgacttacatactcacctccgacacgtaccgaggtaactctacgttcctccctagaaactgtacggtccgtactagttcggtcgacgggacactacggccgttacttatttagtgtagtactaggaacgtacgtcccggggaccaagttaaccgtcggtccgtccccggcccggttacgggggaccccgggtaacccgtcgggttacccgtacccgttcccgtcccgttaccggacgtcccccgttacccgaaacccgggtacccgggttaccccgttacggttccccgggttaacccctttcccccccggtggggtcccccctaccccgttaccccgttaaccgaaaaccgggtccccg

SEQ ID NO: 337299 - DNA, 660 bp, Homo sapiens
  misc_feature: GZ8MTXP01D89I0.11.85.H08.1.454.CMB.2.raw
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctcggatctccatcacgatactgtattactatggtctttggatccgacacgtcccgagggaacggcctaggagtggtcttggttatcgtccacacgagaggtactccctactaccaacccgtcactacgaaagcgtacgtaacttacatactcactccgacacgtacagactcacgttcacctagaaactgacgtctatagtcgtcgcggtacacgtgtcccgttattatttatgtacgtacagtacgtaccgtcccggggactaaagttaccgcgggtccgtccccgggccccgggtcgggggaccccggtaacccgttcgggtaaccctcccggttcctcccgtcgaacccgtcccgttaaccgaacccggaacgggttccccttacgggttccccgttccccttcccccggtcggtacccctacccccgttacctaacccgaaggtccccg

SEQ ID NO: 337300 - DNA, 665 bp, Homo sapiens
  misc_feature: GZ8MTXP01AMJF9.11.85.H08.1.454.CMB.2.raw
  modified_base (364)..(364): a, c, t, g, unknown or other
  misc_feature (364)..(364): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggactccgacacgtccccgaggggaacggcctggagtggtcttggttatcgtccaccacgaggacggtactccccttaactaccaaccccgtcactacaagacgtacacttacatacncactccgacacgtcaagactacacgttcctacctagaaactcgtacgtcctatacttcggtacgaccggaacacgacgtcccgttattatttagttcgtgtacgaggtaacgtccgttacccgggaccctaagtaaccggtcggcccgtccccgggccccgggtccgggggacccccgtaaccgtcgggtaccctacccggtctccctcgacgtccccttaccgaacccgtaacgggccccttcgttcccggttccccttccccgcggaccctccccttcccgtaaccgaacggaaccccg

SEQ ID NO: 337301 - DNA, 764 bp, Homo sapiens
  misc_feature: GZ8MTXP01DRT6T.11.85.H08.1.454.CMB.2.raw
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctcggatctcatcacgatactgtaattactacgtggtctttggactccgacacgtcccgagggaggcnggagtgctgtatcgtccacanagaggactcccttacaccacccgtcactacaagtagtcgtaacttaccaatactaccaacgtacccgaaccgtaacgtacccgaaagggtaaacttccgtaacgtttccccgtacccgtaacgtaaaaacgttcggtaaccgggttcccgtactaacgtttcgtaccggacgggtaaccacgtacgtacccggtttactttaagttttaagttcggttagtaccgaaggtaacgtacccgttccccgggggaaccccttaaagttaaaccggtcgggtacccgtccccggggtccccggggtaccggggggtaacccccggtaaacccgtcggggttacccctacccgggttccctaaccgttccaccgggtaccccttaccgaaacccgaaccggggccccttacggttccccgttaaccccgttccccgtccggaccctacccccgttcctaacccgaacgtaacccg

SEQ ID NO: 337302 - DNA, 757 bp, Homo sapiens
  misc_feature: GZ8MTXP01DCT1H.11.85.H08.1.454.CMB.2.raw
  modified_base (432)..(432): a, c, t, g, unknown or other
  misc_feature (432)..(432): n is a, c, g, or t
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggatctcatcacgatactgattactatgtcttgactccgacacgtcccgaagggaggccgtggagtggtcgtggttatcgtaccacacgagacggtactaccctacaccaccgtcaactacaagacgtacgacttacatactcactacccacacgtacgagaactcgtaacgttccctaccgtaagtaaacgtggacgttccgtatacgtcgtcgacggtaacncgtaccgtccgttactttaagttattcggtagtacgaagtaacggtacccgttcccgggggaaccctaaggttaaccgtcgggtaccccggttccccgggcccccgggtttaccggggggaaccccccggttaacccggtccggtacccgtaaccccgggttccttaacccggcccgttacccgtcccccgttaaacccgaaaccccgggtaaccgggttcccccgttacgttccccccgggttttcccccgttacccccggaacccgggttacccccccgtacccccttaccccggtaaacccgttaaaacccggggtccccgg

SEQ ID NO: 337303 - DNA, 658 bp, Homo sapiens
  misc_feature: GZ8MTXP01BEWD0.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcacgatactgattactactggtctttggactccgacacgtccccgaggggaacggcgtggagtggtcttggttatgtccaccacgagaggactcccttactacaacccgtcactacgaagagtcgtacttacatactcactccgacacgtcagatcagttcacctagaaactgacgtctctacgttcgacgcggtacacgtacgccgttatactttagttgtgtacagacgtacgtcccggggacctaagtaaccgtcggaccgtcccgggccccggttacggggggacccccggtaacccgttcgggtaccctacccgttccttccctaccgacgtccccttaaccgaccccggtaacgggcccccttacggttccccggttccccgttccccccgtcggacccctccccgttacccgtaacccgttaaacggaacccgg

SEQ ID NO: 337304 - DNA, 666 bp, Homo sapiens
  misc_feature: GZ8MTXP01BHF47.11.85.H08.1.454.CMB.2.raw
  modified_base (401)..(401): a, c, t, g, unknown or other
  misc_feature (401)..(401): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggactccgacacgtccccgaggggacggctggagtggcttggttatgtccaccagagaggactcccttaactaccaaccccgtcactacaagacgtacgacttaccatactcactccgacacgtcagactcagttctccagaaactgacgtcctntattcgtcgacgacacgacgtccgttacttatttagttggtcgtacaggtacgtaccgttcccggggaccctaagttaaccgtcgggaccgttcccggggccccggtcgggggacccccggggtaacccgtcgggtaccctacccggttccctccgccgaccggtccccttcccgaaacccggaaccggggttccccttacgttccccggttccccttacccccggtcggaccccctaccccgttccctaacccgaaacgtcccg

SEQ ID NO: 337305 - DNA, 666 bp, Homo sapiens
  misc_feature: GZ8MTXP01CTT3J.11.85.H08.1.454.CMB.2.raw
  modified_base (399)..(399): a, c, t, g, unknown or other
  misc_feature (399)..(399): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgagggaacggccgtggagtggcttggttatcgtccacacagaggactcctactacacccgtcactcagagtcgactacatactcactccgacacgtcaggaactactacgttcctccctagaaactgacggtcctntacttcgtcgcggacacgtacgccgtacttattattgtgttacagtacgacgtccggggacccagttaaccgtcgggacctccgggcccccggtgggggacccccggtaacccgttcgggtacccgtacccgttccgtccccgtcgacccgtccccttacccgaaaccccggtaaccggggttcccccttaacggttcccccgggttcccctttccccccggtcgggccccctacccccgttcccgtaacccggaaacggtccccgg

SEQ ID NO: 337306 - DNA, 658 bp, Homo sapiens
  misc_feature: GZ8MTXP01DJAT0.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccagggaaggcctggagtggcttggttatgtccaccagagaggactcccttactacaaccccgtcactcaagagtacgacttacatatcactccgacacgtcagactcagttctcctagaaactgaacggtccgtctattcgtcgcggacacgacgtcccgtacttatttagttgtgttacagaacgtctccgggggaccctaagttaaccgcgggtaccttcccgggccccgttcggggggacccccggtaacccgttgggtacccaccggttccctccccgttcaccggtccccttaccgaaacccggtaaccggggccccttaacgttccccgggttcccctttaccccccgtcgggtcccctaccccgttccctaacccgaaacgtaacccgg

SEQ ID NO: 337307 - DNA, 657 bp, Homo sapiens
  misc_feature: GZ8MTXP01CFIMO.11.85.H08.1.454.CMB.2.raw
  modified_base (274)..(274): a, c, t, g, unknown or other
  misc_feature (274)..(274): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcaccttcaatgtctccggagtctccatcaccgatactgattactactgtcttggatccgacacgtccccgaggacggctggngtggcttggtatcgtccacacagacggactccctactaccaacccgtcactacaagagtaccgactaccatatcactcgacccacgtacagatcaagttcctcctagaaacgtcgtacggtccgtctagttgtcgacgacacgacgtccgttatatttattgtgtacgagacgtctacccggacctaagtaaccgtcggccgtcccggccccggtacgggggaccccggtacccgtcggtaccctaccggtccctcccgtcaccggttccctaccccgaacccggaaacccggggtccccttaccggttccccgggttccccttaacccccccggtggtaaccccctaccccgtcccgttacccgaaccgaaccgtaaccccg

SEQ ID NO: 337308 - DNA, 687 bp, Homo sapiens
  misc_feature: GZ8MTXP01D2KM4.11.85.H08.1.454.CMB.2.raw
  modified_base (394)..(394): a, c, t, g, unknown or other
  misc_feature (394)..(394): n is a, c, g, or t
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggccaggactggtgaagccttcacagacgctgtccctcacctgcaatgtctcgagtctcatcacgatactgtattactactggtctttggactccgacacgtcccgagggacggccgtggagtggtcttaggttatcgtccaccacgaggtacggacttccctacaccgtaacccgtcactacaagtacgtacgacttacatactacactccgaacacgtacagaactacacgtttccncctaagtaaactggtacggtccgtactagttcgtacgacggacacgacgtccgttacttagtttatcggtatcaaggagtaaccgtccgggggaccctaagttaaccgtcgggtaccgtccccgggtccccggtcgggggtaccccgggtaacctcggggttaccctacccgtcgtccctacgttccgtccccgttaccgaaacccgggtaacggccccgttacgttcccgggtttaacccccttccccgtaacggtccccctaaccccttcccgaaccgttaacggaacccg

SEQ ID NO: 337309 - DNA, 702 bp, Homo sapiens
  misc_feature: GZ8MTXP01APMVH.11.85.H08.1.454.CMB.2.raw
  modified_base (300)..(300): a, c, t, g, unknown or other
  misc_feature (300)..(300): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcacgatactgattactatggctttggatccgactacgtccccgagggaacgggcctggagtggcttggttatcgtccacganaggtaggtactccccttactaacaaccccgttcactcaagacgtccgacttaccatactacactacccgaactacggtaccaaggtaactacgtagttccctccctaagaaaccgtggtaccggtccgtctaagttcgtacgcgggaacacgacgtcgtcttattagttgtgttacagtacgacgtcccgggggtacctaacgtaaccgtcgggtcccgtcccggggtccccggttccggggggacccccgggtaccccgttcggggtacccctcccggttccctccgttccgaccggtccccacccgtaaacccgaacccgggttcccgttaccggttccccgttccccgttccccccgtcgggcccctaacccccgttcccgtaaccgaaacggtccccg

SEQ ID NO: 337310 - DNA, 709 bp, Homo sapiens
  misc_feature: GZ8MTXP01DXOQN.11.85.H08.1.454.CMB.2.raw
  modified_base (330)..(330): a, c, t, g, unknown or other
  misc_feature (330)..(330): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcatgtctccgatctcatcacgtatactgtacttactactggtctttggatccgacacgtccccgaggggaaggccgtggagtggtcttaggttatcgtccacacgagaggactcccttacaccaaccccgtnactacaagacgtacgacttaccatactcacctaccgaccacgtaccaaggtactaacgtacgttccctaccgtacgtaaacgttggacggttccgtacgtaactttcggtacgaccggaacacgtacggtcccgttattaatttagttcgtacgttacgaagagtaccgtcccggggaaccctaagttaaccgtcggaccgtcccgggtccccggtcgggggtacccccgtaaccggttcgggtaccctacccgttcgcccgttcgaccggtccccttacccgaaacccggtaccggggttacccccttgtttaccccgggttccccttaccccgtccggtcccctaccccgtttcccgaacccgaacggtaaccccgg

SEQ ID NO: 337311 - DNA, 667 bp, Homo sapiens
  misc_feature: GZ8MTXP01CN46H.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgagggaacggcctggagtggtcttggttatcgtccaccacgagaggactcccttactaccaaccccgtcactacaagagtcgacttaccatactcactcccgacacgtcagactctacgttctacccgtagaaacgtgacggtccgtctacgtttcgtccgacggacacgtacgtcccggttactttaagtttagttgtacgttacgaaggtacgtaccgtcccgggggaccctaagtaacccgtcgggtcccgtccccgggccccgggtcgggggacccccggtaacccgttcgggtaccctacccggttcctcccgtcgaccggtccccttacccgaaccgacgggccccttcggttcccgttccctcccccgtggcccctaccccttcctccgaacgcccg

SEQ ID NO: 337312 - DNA, 672 bp, Homo sapiens
  misc_feature: GZ8MTXP01CKISC.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcacgatactgattactactggtctttggactccgacacgtccccgaggggacggcctggagtggcttggttatcgtccaccacgagaggactcccttactacaccgtcactcaagacgtcgacttaccatactcactccgacacgtcaagactactagttcctacccgtagaacgtgacggttccgtacagttcgtcgacggtacacgacgtccgttacttattagttgtgtacagtacgtacgtcccggggacctaacgtaacgtcggtccggtcccggaccccggtcgggggtaccccgggtaaccccgttcgggtacccctacccggttcctcccgtcccgaacgccccgttaccccgaaaccgacccggggttaccccgttacgttcccgggttaaccccttccccggtccgggacccctaccccgttccccttaaccgaaaccggtcccg

SEQ ID NO: 337313 - DNA, 828 bp, Homo sapiens
  misc_feature: GZ8MTXP01DD1HY.11.85.H08.1.454.CMB.2.raw
  modified_base (366)..(366): a, c, t, g, unknown or other
  misc_feature (366)..(366): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcatgtctcggatcctcatcacgatactgtaattactactggtctttggactccgactacgtcccgagggaacggctggagtggtcttggttatcgtaccaaccgacgaggacgggacctcccgttaactaccgaaccccgtcaactcgaagcgtacgacttacatacncactccgactacgtccaaggtactacgagtttccctacctagtaaaaccttcggtaacgggttcccgtacttaaactttcgggtacccgaccggaacacgtaaccggtccgtttaacttagtttttagtcggttacgttacaaggtaacgtacccgttacccgggggtaccccttaaagttaaacccggtcggggtacccggttcccccggggtaccccccgggttaccgggggggtaaacccccccggttaacccggttccgggggttacccctaaccccgggtttcccttccccggttaccgaaccccgggtccccctttaaccccggaaacccgggttaaccccgggggttaccccttaacccggtttacccccggggtttaacccccgtttcccccccggtccggggtaccccccttaacccccttccccgtttaaccccgaaaccgggtaaccccgg

SEQ ID NO: 337314 - DNA, 822 bp, Homo sapiens
  misc_feature: GZ8MTXP01C6I7Q.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtcctccatcaccgatactgattactactggtctttggactccgacacgtccccgagggacggcctggagtggtcttggttatcgtaccaccacgaggacggtacctccccttaacctaacctaaccccgtcaactacgaacgtagtaccgaacttaccaatactacactacccgaccacgtaccgaaggaacttacctacgtttccctcccttaaacggaaaccgttcgggtacggtcccgttactacgttcgtacggaccggtaacaaccggtcgtaccccgttatttaacgttttagttggtacgttacaacggaacggtacccgttaccccgggggaccccttaaagtttaacccgtcggggtaccccgtccccgggggtccccccgggtacggggggtaacccccccgggtaacccgttcggggtacccccaccccggtttccccgtccccgtaccgttaacccgggttaccccccacccggtaaacccccgggtaaaccgggggttccccccttaacgggtttccccccggtttaacccccttacccccccggtcgggtaacccccctacccccgtttaccctaaccccgaacgggtaacccccg

SEQ ID NO: 337315 - DNA, 859 bp, Homo sapiens
  misc_feature: GZ8MTXP01ANFFA.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgacaatgtcctccggagtcctccatcacgtatactgtattactagtggtctttggactccgacacgtcccgagggacggcctggagtggtcgttaggttactcgtacccaaccgtacgagggtaacgggtacctttacccccgtttaaacctaaccccgtaacccccggtacaacctaaccggaaacggtaccggttaacccgtaaccctttaaaccctaattaacctaccaaccgttaccccggaacctacggtaccgaaaggtaacttacctacgtttccctacccgtaagaaaccgttggtaccggttcctactacgtttacgccggaaccggaccacgtaccgtaccgtttacttaagtttagttcggtcgttacgaagggtacgtaccccggttaccccgggacccgtaaagttacccgtccggggtccccgtccccgggggtaccccggtcccgggggtaaccccccgggtaaccgttccgggtaccccgtccccggttccctaacccgtccggttaaccccggtcccccttaaaccccggaaaccccggtaacccggggttacccccttacgggtttcccccccgggttaacccccttccccccggtcggtaccccccttaccccgttacccgtaacccgaaacgggtcccccg

SEQ ID NO: 337316 - DNA, 756 bp, Homo sapiens
  misc_feature: GZ8MTXP01AXI49.11.85.H08.1.454.CMB.2.raw
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtcctcatcacgatactgattactactggtctttggatccgacacgtccccgagggaggccnggngnggcttggtatcgtaccacanagaggactcccttactaccacccgtcactacagacgtcgacttacatacncactcccgacacgtacgaaggtaactctacgttccctaccctaagtaaaccgtcgtaacgggttcccgtactacgttcggtaccggaccgaacctacgaaccggtcccgttaactttaagttttacgttggttacggactaacgggtaacgtaccgtccccgggggaaccctaagtaaacccgttcggggacccctccccggggtcccccggttaccggggggaaccccccggttaacccggttcgggtaccccggtaaccccggtttccctccccgtcgacccggtacccccttacccgaaacccggtaaccccgggggttccccttacgggtttcccccggttccccgtttccccccgtaacgggtaccccctacccccgttcccgtaacccgaacggtaaccccgg

SEQ ID NO: 337317 - DNA, 628 bp, Homo sapiens
  misc_feature: GZ8MTXP01AGIVO.11.85.H08.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcaccgatactgattactactggtctttggatccgacacgtccccgagggaggctggagtggcttggtatgtccaccanagaggactcctacacaacccgtnactcaagagtcgacttaccatatcactccgacacgtcagatcagttcctcctagaaactgacgtcgtcattgtcgcggacacaggtccctatattatgtgtcgagactacgccccggggctaagtacgtcgggccttacccgggcccccgttgggggacccccggttaaccgtcgggtacccgtacccggttcctcccgtcgaccgtccccttaccgaaaccccggaacgggttccccttacggttcccgggttcccctttcccccgtcggaaccccctccccgttacccctaacccgaaacgggccccg

SEQ ID NO: 337318 - DNA, 672 bp, Homo sapiens
  misc_feature: GZ8MTXP01B0240.11.85.H08.1.454.CMB.2.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (422)..(422): a, c, t, g, unknown or other
  misc_feature (422)..(422): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggccaggactggtgaagccttcacagacgctcgtccctcacctgcaatgtctcggatctccatcacgtatactgtattactacgtggtctttgatccgactacgtcccgagggacggctggagtggnttggtatcgtaccacagagnggactcctaacacaaccctcactcaagtacgtcacttacatactcactccgacctacgtacgaagactctacgttccctaccagtaaactggtacggtcctatacgttcgtacgacgaacncgtacgccgtttacttagtttacttggtatacgagtagtccgtacccggggactaagtaccgtcgggacccgtcccgggccccgggtacgggggacccccggtaaccgtccggttcccgtaccccgttcggttccccacgttcccgtaccccttccgaaacccgggtaaccgggttccccttacggttccccgggtaaccccttcccccgtaacggccccctaccccgttcccgtaaccgaaggtccccg

SEQ ID NO: 337319 - DNA, 493 bp, Homo sapiens
  misc_feature: GZ8MTXP01C5V96.11.85.H08.1.454.CMB.2.raw
  modified_base (273)..(273): a, c, t, g, unknown or other
  misc_feature (273)..(273): n is a, c, g, or t
  modified_base (391)..(391): a, c, t, g, unknown or other
  misc_feature (391)..(391): n is a, c, g, or t
  modified_base (411)..(413): a, c, t, g, unknown or other
  misc_feature (411)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaaatgggtcctgtcccaggtacacctggtggagacgggcccaggactggtgaagccttcacagacgctgtccctcacctgcaaatgtctccggatctcatcaccgatactgattactactggctttggatccgacagtcccaggaaggctgagngctgtatgtcacacagaggatccctactacaaacccgtcactcaagagtcgacttaccataatcactccgacagtccaaggaatcaattctccctgaaaactgagtcgtcattgtcgnggacacagcgtctatatgtnnnanancgcanangcncgccgcggccggaccgtcgcncnctcncncncncacacgacgcncgtctcctcncnccnctcncgn

SEQ ID NO: 337320 - DNA, 627 bp, Homo sapiens
  misc_feature: GZ8MTXP01BF7U0.11.85.H08.1.454.CMB.2.raw
  modified_base (590)..(590): a, c, t, g, unknown or other
  misc_feature (590)..(590): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccgagggaaggcctggagtggcttggttatgtccaccacagaggactcccttactacaaccccgtcactcaagacgtcgacttaccatatcgactccgacacgtcagatcagttcctcctagaaactgacgtcctatattcgtacgcggaacacgacgtccgtactattattgtgtctaagacgtacgtcccggggacctaagtaacgtcggtacgtcccggccccggtcgggggaccccggtaacccgtcggtcctacccggtcctaacccgtcgacgtcccgttccgaaccgaaccggggccccacgttccccgggtccttcccccgnggtcccctaccccgttccctaaccgttaacgtaaccg

SEQ ID NO: 337321 - DNA, 707 bp, Homo sapiens
  misc_feature: GZ8MTXP01D16GY.11.85.H08.1.454.CMB.2.raw
  modified_base (290)..(290): a, c, t, g, unknown or other
  misc_feature (290)..(290): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcatgtctcgatctcatcacgatactgtaattactactggtctttaggactccgacacgtcccgaaggggaggcctggagtggcgttggttancgtccacacaggacggtactccccttactaccgaaccccgtcaactcaagtacgtcgtaacttaccatactacactaccgacctacgtaccgaaggtactacctacgttcctacccgtagtaaaactggtacggtccgtactagttcggtcgacggtacacgtacgtccgtacttagtttagttcgtgttacgacggtaaacgtcgtaccccggggtaccctaagttaaacccggtccgggtaccgttccccgggccccggttcgggggtacccccggtacccgtcgggtcccgtacccgttcccgtcccgttaccgccgtccccgttaccgacccgggtaaccggacccgttcgttcccgggttcccctacccccggttcggacccctccccttacccgtaaccgaacggttcccg

SEQ ID NO: 337322 - DNA, 669 bp, Homo sapiens
  misc_feature: GZ8MTXP01CNVHQ.11.85.H08.1.454.CMB.2.raw
  modified_base (214)..(214): a, c, t, g, unknown or other
  misc_feature (214)..(214): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtcncatcacgatactgattactactggtctttggactccgacacgtccccgagggaacggccgtggagtggtcgttggttactcgtaccaccagaggacgggacttccccgttaactaccgaaccccgtcacctacaacggacttcgaccttacatatcactccgacacgtcaaggactctagtcctcctaagtaactgacgtccgtctagttcgtcgtacgacacgcgtccgtatttagttacgttgtacgtcgaagttacgaacgttcccgggggtacctaagttaaccgcggtcccgttaccgggcccccggttcggggaccccggtaaccgtcggtaccgtcccggttcctccgtacgccgttcccacccgtaacccgtacggccccgttcgttccccggttcccgttcccccgtggtccccctcccgttaccccgtaaccgaacggtaacccg

SEQ ID NO: 337323 - DNA, 625 bp, Homo sapiens
  misc_feature: GZ8MTXP02HUOA6.11.85.H08.1.454.CMB.2.raw
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttacatatcactcgacacgtcagatcagttctcctagaaactgagtccgtnattcgtcgcggtacacgacgcccgttntatttattgtgtacagagtacttcccgggaccctaataacgtcgggccgtccgggcccccgttcgggggacccccggtaacccgttcgggtccacccggttcctccgtacgaccggaccctcccgaacccgaaacggggccccctaacgttcccgggttcccttccccccgtcgggtaccccaccccttccccgtaccgaaacgtcccg

SEQ ID NO: 337324 - DNA, 544 bp, Homo sapiens
  misc_feature: GZ8MTXP02FULKP.11.85.H08.1.454.CMB.2.raw
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (481)..(481): a, c, t, g, unknown or other
  misc_feature (481)..(481): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttgggttatgtccaccacagagggatcccttactacaacccgtnactcaagagtcgacttaccatatcactcgacacgtccagatcagttcncctgaaactgagtccgtcattgtcgcggacacagcccgtctactttattgtgtcagagatccggcccatactggctcggccctggggcccggaacctggtcaccgtcncctcacgcctccgaccacgggcccagtccggtccttcccctggcccacccctctccaagaccg

SEQ ID NO: 337325 - DNA, 579 bp, Homo sapiens
  misc_feature: GZ8MTXP02GQSRL.11.85.H08.1.454.CMB.2.raw
  modified_base (551)..(551): a, c, t, g, unknown or other
  misc_feature (551)..(551): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactccgacacgtcaggatcagttctcctgaaactgacgtccgtcattgtcgcggacacgagcccgtctattattcgtgtcagagtatcccggccctataacgtcggcctccggccccgtcgggggccccggtaaccctggtccaccggtcctccgtcacgccctaccaccgtaacgggccccagttcccggtccttcccccgnggcccctacccgtccctccaaacgtccg

SEQ ID NO: 337326 - DNA, 573 bp, Homo sapiens
  misc_feature: GZ8MTXP02JHUPV.11.85.H08.1.454.CMB.2.raw
  modified_base (437)..(437): a, c, t, g, unknown or other
  misc_feature (437)..(437): n is a, c, g, or t
tcagcgagagataccacgaccggtgctcgatttagtatcactcaggtcgcggggtcctggacctcctgtgcaagaccatgaaacacctgttgttcttcctcctgctggtggcagctcccaaatgggtcctgtcccaggttacacctggtggagacgggtcccaggactggtgtaagccttcacagacgctgtccctcacctgcaatgtctccggagtctccatcaccgatacgtgattactactggctttggatccgacacgtccccagggaacggcctggagtggcttggttatgtccacacagagggactcccttactacaacccgtcactcgaagagtcgactttaccatatcactccgacacgtccagactcagttcctcctgaaactgagtccgtcattcgtcgacggacacacgccgtatacttattcgtntcagagactccggcctataaccgtggacctccggccccgtgggggcccccggaaccgttggtacctaccgtctccgtcacgccctccaccgacgggcccagtccgtcctcccctggcccacctcctacgacgaccg

SEQ ID NO: 337327 - DNA, 354 bp, Homo sapiens
  misc_feature: GZ8MTXP02HSMD2.11.85.H08.1.454.CMB.2.raw
  modified_base (353)..(354): a, c, t, g, unknown or other
  misc_feature (353)..(354): n is a, c, g, or t
tcagcgagagataccacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccggagatcatgagggtgtccttgggtttgggggaagaggaagactgacggtcccccaggagttcaggtgctgggcacagcgaccctgggctgcctggtcaaggactactccgtatctctcgctgagcgggctggcaaggcgcatagnn

SEQ ID NO: 337328 - DNA, 547 bp, Homo sapiens
  misc_feature: GZ8MTXP02IM3B2.11.85.H08.1.454.CMB.2.raw
  modified_base (395)..(395): a, c, t, g, unknown or other
  misc_feature (395)..(395): n is a, c, g, or t
  modified_base (524)..(524): a, c, t, g, unknown or other
  misc_feature (524)..(524): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactgactttggatccgacagtccccaggaaggcctggagtggcttggtatgtccacacagaggatccttactacaacccgtcactcaagagtcgacttaccatatcactcgacacgtccaggatcagtctcctagaaactgacgtcgcattgtcgcganacagccgtatattattgtgtcagagatccggacccataactgggcctcggccccgtcggggccccggaaccgtcggtccaccgtcctcctcacgcctccaaccacgggcccagtccgtccttcccccgnggcccacctccctccaacgaccg

SEQ ID NO: 337329 - DNA, 594 bp, Homo sapiens
  misc_feature: GZ8MTXP02GIQ0G.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggagggcctggagtggcttggttatgtccaccacagagggatcccttacacaacccgtcactcaagagtcgacttaccatatcactccgacacgtccaggaatcagttcctccctgaaacctgacgtccgtatagttcgtcgacggacacgacgtccgttacttattagttgtgtacagacgacgtcccggacctattaacgcggcgtcccggcccggtcggggacccggacccgtggtcccgaccgtcctccgtcaccgtccctaccaccgtacgggccctacgtcccggtcccttccccgcggaccctacccctcctaccaacggaccg

SEQ ID NO: 337330 - DNA, 540 bp, Homo sapiens
  misc_feature: GZ8MTXP02GOQIW.11.85.H08.1.454.CMB.2.raw
  modified_base (376)..(376): a, c, t, g, unknown or other
  misc_feature (376)..(376): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatccccttactacaacccgtcactcaagagtcgacttaccatatcactccgacacgtccaggaatcagttcnccctgaaactgagtcgtcattgtcgcggacacagccgtctattattgtgtcagagatccggcccataactggctcggcccctggggcccggaaccctggtcaccgtctcctcagcctccaccaacgggcccatcggtctccccctggccaccctctccaagacg

SEQ ID NO: 337331 - DNA, 584 bp, Homo sapiens
  misc_feature: GZ8MTXP02HGHVL.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggctttggatccgacagtccccagggaaggcctggagtggcttggttatgtccacacagaggactccttactacaacccgtcactcaagagtcgacttaccatatcactccgacacgtccaggaatcagttctccctgaaaactgacggtccgtcattagtcgcggacacgacgccgtactattattgtgtcagagactccggccctaagtactggctccggccccgtcgggggccccggaacctcggtacctaccgtcctcctcgacgccctaccgaaccgaacgggccccaacgttccggtccctttcccccgcggtacccaccccgttccacccgaagacccg

SEQ ID NO: 337332 - DNA, 558 bp, Homo sapiens
  misc_feature: GZ8MTXP02GMZFX.11.85.H08.1.454.CMB.2.raw
  modified_base (275)..(275): a, c, t, g, unknown or other
  misc_feature (275)..(275): n is a, c, g, or t
  modified_base (534)..(534): a, c, t, g, unknown or other
  misc_feature (534)..(534): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggctttggatccgacagtccccagggaggcctggagnggcttggtatgtccaccacagaggatcccttactacaacccgtcactcaagagtcgacttaccatatcactccgacacgtcaggaatcaagttcctccctgaaacctgagtccgtcattgtcgcggacacagcccgtctattattgtgtcagagatccggacccaataacgtggctccgggccccgtgggggcccccggaacctcggtaccaccgtctcctcacgcctaccaccgaggccccatccggtccttcccccnggcccaccctcctacccaagaccg

SEQ ID NO: 337333 - DNA, 591 bp, Homo sapiens
  misc_feature: GZ8MTXP02GN4QF.11.85.H08.1.454.CMB.2.raw
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaggctggagtggcttggtatgtccacanagaggatccttactacaaccgtcactcaagagtcgacttacatancactccgacacgtcagatcagttctcctanaaactgacgtcctntattgcgcgacacagccgttatacttattgtntacgagacgactcccggacctagtaacgtcggccgtcccgggccccggtacgggggaccccggtaaccgtcggtacccaccgtcctcccgtccacgcccctaccgaccgaaccgggcccacgttcccggtcccttcccccgtcggtacccctacccctccgtaccgaacgtacccg

SEQ ID NO: 337334 - DNA, 594 bp, Homo sapiens
  misc_feature: GZ8MTXP02GZRLC.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccagggaaggcctggagtggcttggttatgtccaccacagagggatccttactacaacccgtcactcaagatcgacttaccatatcactccgacacgtccaggaatcagttcctcctagaaactgagtctcattgtcgcggacacgagccgttctattattgtgtcgagagacgtcccgccgtaatacggcgtccggccccggtcgggccggggacccgtcggtccgtaccggtcctcccttccgcgtacccgtccctaccgaaccggcccgtaccgtcccgtcccgtcccccgtccggtacccgaccctcccctaccaacggaaccgtcccgg

SEQ ID NO: 337335 - DNA, 556 bp, Homo sapiens
  misc_feature: GZ8MTXP02GIAT2.11.85.H08.1.454.CMB.2.raw
  modified_base (396)..(396): a, c, t, g, unknown or other
  misc_feature (396)..(396): n is a, c, g, or t
  modified_base (449)..(449): a, c, t, g, unknown or other
  misc_feature (449)..(449): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaaggcctggagtggcttggtatgtccaccacagaggactcccttactaccaacccgtcactcaagagtcgacttaccatatcactccgacacgtcaggaatcagttcctccctagaaactgacgtccgtntattgtcgcggacacgagccgtctattacttgtgtcagagatccggccatacnggctcggcccgtggggccccggaacctggccaccgtctccgtcacgccctccgaccaacgggcccagtccggtccttcccccgtggcccaccctcctaccaacgccg

SEQ ID NO: 337336 - DNA, 557 bp, Homo sapiens
  misc_feature: GZ8MTXP02IDAAX.11.85.H08.1.454.CMB.2.raw
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccagggaaggcctggagtggcttggtatgtccacacagaggactccttacacaacccgtcactcaagagtcgacttacatatcactcgacacgtcagatcagttctcctnaaactgagtcgnattgcgcgacacagccgttctattattgtgtcagagacttccggacctagtactgggcctccggccccgtgggggcccggaaccgttggcctaccgtctccgtcacgcctaccgaccgtacggccctagtcccggtcctttcccccgcggaccctacccctcctacgaacgaccg

SEQ ID NO: 337337 - DNA, 598 bp, Homo sapiens
  misc_feature: GZ8MTXP02JGB8Q.11.85.H08.1.454.CMB.2.raw
  modified_base (563)..(563): a, c, t, g, unknown or other
  misc_feature (563)..(563): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaggcctggagtggcttggtatgtccaccacagaggatccttactacaacccgtcactcaagagtcgacttaccatatcactcgacacgtccagatcattcctcctagaaactgacgtccgtacatttcgcgcggacacgagtccgtactattattgtgtcagagactccggaccctagtaacgtggccctccgggaccccgtcgggggacccccggtaaccgtcgggtacccgtaccgtcctccgtcaccgccctcccaaccgaaccgggtccccacgttcccggtcccttcccccgnggcccctacccccgtcctacccgaaacgaacccgg

SEQ ID NO: 337338 - DNA, 595 bp, Homo sapiens
  misc_feature: GZ8MTXP02HLYYE.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagagggatcccttactacaacccgtcactcaagagtcgacttaccatatcactccgacacgtccaggatcagttctcctgaaactgaggtcctcattgtcgcggacacgagcccgtctattattgtgtcagagattccggcctaatactggcctccggcccccgttagggggcccccgggtaaccctgggtacccacccggtccttcccgtccacggtcccctcccgacccgaacggggcccctacgtcccgggtcccttcccccgtcggaccctacccctccctaccaacgtacccg

SEQ ID NO: 337339 - DNA, 621 bp, Homo sapiens
  misc_feature: GZ8MTXP02F3MJE.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccacacagagggatccttactacaacccgtcactcaagagtcgacttacatatcactccgacacgtcaggatcagttctccctgaaactgaggtccgtcattgtcgcggacacagcccgtctacttattgtgtcagtagacgtccggaccctagtaacctgggacctccgggcccccgttcgggggcccccgggtaaacccgtcgggtaccgacccggttcctacccgttcgacggtcccctacccgaacccgtaacggggcccctaacgttcccgggtccctttcccccccggtcggtccccaaccccgttccctacccgaacgtacccg

SEQ ID NO: 337340 - DNA, 801 bp, Homo sapiens
  misc_feature: GZ8MTXP02JKFWE.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggtctttggatccgacacgtccccagggaagggcctggagtggcttggttatgtccaccacaggaggactccttacaccaacccgtcactcaagagtccgacttaccatactactactacccgaccaccgtaccaaggtaactacgtaacgtttccctacccgtaaggtaaaacctcgggtaaccgggtttcccgtactacgtttcggtaccggacgggtaaccacgacggtacccgttacttaacgtttaatttcggttcgttacgagttaaacggaccgttacccgggaccctaaagttaaacgttcgggacccgtcccgggtccccgggtaccgggggtacccccgggtaaacccgttcgggtacccgtaaccccgttcccgttaccccgttacccgaccggttacccccgtacccccgtaaacccggtaaaacccgggggccccccttaaaccggttcccccgggtttaacccccgtttttaccccccccgggcggggtaacccccccgttacccccgttttaccccctaaccccggaaaacccgggttaaacccccgg

SEQ ID NO: 337341 - DNA, 582 bp, Homo sapiens
  misc_feature: GZ8MTXP02GR6AZ.11.85.H08.1.454.CMB.2.raw
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacagtccccagggaagggcctggagtggcttggttatgtccaccacagaggatcccttactaccaaccgtcactcaagatcgacttacatatcactccgacacgtcagancagttcncctanaaactgacgtcctcattgcgtcggacacgagcccgtactattattgtgtcagagactccggacctataactgggcctccggccccgtcggggccccgggtaaccctggtaccgtacccgtcctccctccgacgccctaccaccgtaacggccccaatcccgggtaacccttcccccgcggcccacccctaccctacccgaacgaccg

SEQ ID NO: 337342 - DNA, 639 bp, Homo sapiens
  misc_feature: GZ8MTXP02JGMX6.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccagggagggcctggagtggcttggttatgtccacacagaggactccttactacaacccgtcactacaagagtcgacttacatactcactccgacacgtccaggatcacgttcctaccctagaaaccgtgacgttccgtctaagttcgtccgccggacaccgaggtcccgttactactttattcgtgtacagagtacctccgggcccaagttaaccgtgggccctcccggggcccccgtcgggggacccccgggtaacccgtccgggtaccgtaccccggttcctcccgtccgacggtccctacccgacccgaaccgggccccacgttcccgggtaacccttcccccgtacggccctacccctccctaccgaaacgccg

SEQ ID NO: 337343 - DNA, 552 bp, Homo sapiens
  misc_feature: GZ8MTXP02FO4TF.11.85.H08.1.454.CMB.2.raw
  modified_base (372)..(372): a, c, t, g, unknown or other
  misc_feature (372)..(372): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagaggatcccttactacaacccgtcactcaagagtcgacttaccatatcactccgacacgtcaggaatcagttcncctgaaactgagtcgtcattgtcgcggacacagcccgtctattattgtgtcagagatccggcccataactggctcggcccctggggcccggaaccctggtccacgtcctcctcacgcctccaccaacgggccccagtcccggtccttcccccgtggcccaccccttccacccgacgaccg

SEQ ID NO: 337344 - DNA, 718 bp, Homo sapiens
  misc_feature: GZ8MTXP02JO1FF.11.85.H08.1.454.CMB.2.raw
  modified_base (331)..(331): a, c, t, g, unknown or other
  misc_feature (331)..(331): n is a, c, g, or t
  modified_base (452)..(452): a, c, t, g, unknown or other
  misc_feature (452)..(452): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggactccgacacgtccccgaggggaacgggccgtggagtggtcttggttatgtccacacagagggactccgttactaccacccgtnactacaagacgtcgacttacatactcactccgacacgtccaaggactcacgttctaccctagaaactgacggtccgtactagttcgtcgccggacacgacgtcccgtacttattattggtnttacgagtacgcgtacccgggacctaagtaaccggtcggaccgtcccgggcccccgggtaccgggggtaccccccgggaaccggttccgggtaccccgtacccggttccctaccccgttaccgaacccgtcccccgttaccccgaacccgggaaaccccggggtccccctaaccgggtttcccccgggtaaccccgtttcccccccggtaccggggtaccccctaacccccgttcccccgttaaccccggaaacggtaacccccgg

SEQ ID NO: 337345 - DNA, 613 bp, Homo sapiens
  misc_feature: GZ8MTXP02JF9KV.11.85.H08.1.454.CMB.2.raw
  modified_base (431)..(431): a, c, t, g, unknown or other
  misc_feature (431)..(431): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccacacagagggatccttactacaacccgtcactcaagagtcgacttaccatatcactccgacacgtccagatcagttctcctagaaactgacgtcgtctattcgtcgcggacacgagcccgtctattactgtgtcaganactcccggaccataacgtgggaccttccggccccgtgggggacccccggtaacccgtgggtacccgaccgtcctccccgtacaccggtcccctaccgaacccgaacggggtcccccaacgttcccgggtcccttccccccgtacggcccctaacccccgttccctacccgaaaacggcccgg

SEQ ID NO: 337346 - DNA, 679 bp, Homo sapiens
  misc_feature: GZ8MTXP02F12DG.11.85.H08.1.454.CMB.2.raw
  modified_base (418)..(418): a, c, t, g, unknown or other
  misc_feature (418)..(418): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaggcctggagtggcttggtatgtccaccacagagggactcccttactacaacccgtcactcaagagtcgacttaccatatcactccgacacgtcaggatcagttctcctagaaactgagtctcattcgtcgcggacacacgccgtactattnttagtgtacagacgactcccgggaccctaagtaaccgtcgggtccgtcccggggcccccggttacggggggacccccgggtaaaccccgttcggggtacccgtaccccggttcccttacccgttacccgaccggtaccccgttaccccgaaaccccgtaaaccgggggtaccccctaacgtttccccggggttaacccctttcccccccggtcgggtaccccctacccccgttacccgttaccccgaaacggtaaccccgg

SEQ ID NO: 337347 - DNA, 528 bp, Homo sapiens
  misc_feature: GZ8MTXP02FZAPJ.11.85.H08.1.454.CMB.2.raw
  modified_base (392)..(392): a, c, t, g, unknown or other
  misc_feature (392)..(392): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggttatgtccaccacagaggactcccttactacaacccgtcactcaagagtcgacttaccatatcgactccgacacgtccagatcagttctccctgaaactgagtccgtnattgtcgcgacacagccgtctattatgtgtcagagatcgcccatactgctcgccctgggcccggaactggtcacgtctcctcagcctccacaacggcccagtccgtcttcccccnggccaccctccnccaacgccg

SEQ ID NO: 337348 - DNA, 687 bp, Homo sapiens
  misc_feature: GZ8MTXP02ICBFQ.11.85.H08.1.454.CMB.2.raw
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccagggaacgggcctggagtggcttggttatgtccacacagaggactcccttactaccaacccgtcactacaagngtcgacttacatatcactccgacacgtcaggactcagttctcctanaaactgagtccgtntattcgtcgcggacacngccgttctatttatgtgtcagagacgtccggaccctaagtaacgtcgggtaccgtcccggggacccccggttcgggggacccccgggtaaccccgttcgggtacccgtaaccccgggttccttcccgttacccgaccggtacccccttaccccgaaacccccggaaaccgggggtcccccctaacgttccccggggttcccccttttccccccggaaccggggttccccctaaccccccggtttccccttaacccgtaaaacggaaacccccgg

SEQ ID NO: 337349 - DNA, 646 bp, Homo sapiens
  misc_feature: GZ8MTXP02F3QMW.11.85.H08.1.454.CMB.2.raw
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
  modified_base (599)..(599): a, c, t, g, unknown or other
  misc_feature (599)..(599): n is a, c, g, or t
tcagcgagagataccacgaccggtgctcgatttagtatcactcagtcggcgggtcctggacctcctgtgcaagaccactgaaacacctgttgttcttcctcctgctggtggcagctcccaaatgggttcctgtcccaggtacacctggtggagacgggcccaggacctggtgaagccttcacagacgctgtccctcacctgcaatgtctccggagtctccatcaccgatactgattactactggtctttggatccgacagtccccagggaggcctggagtggcttggtatcgtccacactagaggatcccttactacaacccgtcaacctcaagagtcgaactttaccatatcactccgacacgtacaggaactcagttcncctagaaactgagtccgntaacttgcgacggacacgngtcccgtatatttattgtgtcagtagactcccggacccagttaacncgggtacctaccggccccgttgggggacccccggtaacccgtggtccgaacccggttctcccgttaccggacgtcccctaccgacccgtaaaccggggtcccccaagttccccggggttccctttccccccgggngggtaccccctaacccccgtttccctaccccgtaaaacggtaccccg

SEQ ID NO: 337350 - DNA, 659 bp, Homo sapiens
  misc_feature: GZ8MTXP02GJYKB.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggctttggatccgacagtccccgagggaagggcctggagtggcttggttatcgtccaccacagagggactccttactacaacccgtcactcaagagtcgacttaccatatcactccgacacgtacaggatcagttcctcctagaaactgagtccgtcattgcgtacggacacgacgtcccgttagtatttattggttcgttacgaaggtaacgtacgttccccgggaccctaacgttaaccgtcgggtacccgttccccggggacccccggttcggggggaccccccggtaaacccgttcgggtacccgtacccgttccctcccgtccaccggtcccctacccgaaccgaaccgggtccccacgttcccgggttcccttccccccgtcggaccccctaccctcccgtaccgaaacgtcccg

SEQ ID NO: 337351 - DNA, 650 bp, Homo sapiens
  misc_feature: GZ8MTXP02JQIQU.11.85.H08.1.454.CMB.2.raw
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgagggaggcctggagtggcttggttatgtccacacgaggagggtactcccttactaccaacccgtcactcaagacgtcgacttaccatatcactccgacacgtacagaatcattcctcctagaaactgacgttccgtntagttgtcgcggacacagtccgtctattattgtntacgagacgactcccggacctaagtacgtcgggaccgtcccgggccccggtcgggggacccccggtaccgtcgggtaccctacccggtccctacccgtacgccgacccgtacccgaacccggtaaaccggggcccctaacggttccccggttccccgtttccccccggtacggtaccccctacccccgtttaccctacccggaacgtacccccgg

SEQ ID NO: 337352 - DNA, 568 bp, Homo sapiens
  misc_feature: GZ8MTXP02FODUH.11.85.H08.1.454.CMB.2.raw
  modified_base (376)..(376): a, c, t, g, unknown or other
  misc_feature (376)..(376): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttgggttatgtccaccacagagggatcccttactacaaccccgtcactcaagagtcgacttaccatatcactcgacacgtccaggaatcagttcnccctgaaactgagtccgtcattgtcgcggacacagccgtctattattgtgtcagagactccggcccataactggctcggcccctggggccccggaacctcggtcaccggtctccctcacgccctccaccgaaacgggccccaagttccggtcccttccccccgtggcccaccccctccctacccaacgaccg

SEQ ID NO: 337353 - DNA, 615 bp, Homo sapiens
  misc_feature: GZ8MTXP02FMNZE.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgagggaaggcctggagtggcttggttatgtccaccacagagggactccttactaccaacccgtcactcaagagtcgacttaccatatcactccgacaccgtccaggaactcacgttcctccctagaaactgacgtccgtctattgtcgacggacacgacgtccgtactatttattgtgtacagagctccggaccataacgtcgggacctccggccccgtcgggggccccggtaacccgtggtacccgaccgttcctcccgtcgaccgccctacccgaaccgaccgggtcccctacgttccccggtcccttcccccgcggacccctacccccgttccgtacccgaacggaccg

SEQ ID NO: 337354 - DNA, 631 bp, Homo sapiens
  misc_feature: GZ8MTXP02JN0EN.11.85.H08.1.454.CMB.2.raw
  modified_base (254)..(254): a, c, t, g, unknown or other
  misc_feature (254)..(254): n is a, c, g, or t
  modified_base (288)..(288): a, c, t, g, unknown or other
  misc_feature (288)..(288): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccganacgtccccagggaaggcctggagtggctggttangtccacacagaggactccttactacaaccgtcactcaagagtcgacttaccatatcactccgacacgtccaggatcagttcncccagaaactgagtccgtnattgcgacggacacagcccgtntattagttcgtgtcagtagacgtccggccctaataaccgtcgggaccttcccggggcccccgttgggggacccccgggtaaaccccgttggggtccctaacccggtcctcccgttacccgaccgacccgtacccgacccgaaccggacccgtacccgttcccggttccccgttcccccgtacccggtacccgtaccccgtaccccgtacccgaacgaccg

SEQ ID NO: 337355 - DNA, 610 bp, Homo sapiens
  misc_feature: GZ8MTXP02GIQME.11.85.H08.1.454.CMB.2.raw
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccgagggaggcctggagtggcttggttatgtccaccacgagagggactcccttacaccaacccgtcactacaagagtcgacttaccatatcactccgacacgtcagatcagttccncctgaaactgacgtcctnattgcgcggacacagccgtactattattgtgtacagacgactcccggaccagtaaccgtcgggacctcccgggccccgtcgggggccccggtaacccgtcggtcccgacccgttcctcccgtcaccgccctacccgaaccgtaaccgggcccctacgtcccggttcccttccccccgtcggcccctacccccgtacctacccgaaacgtaacccgg

SEQ ID NO: 337356 - DNA, 581 bp, Homo sapiens
  misc_feature: GZ8MTXP02F5VXY.11.85.H08.1.454.CMB.2.raw
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (557)..(557): a, c, t, g, unknown or other
  misc_feature (557)..(557): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaggcctggagtgcttggttatgtccacacagaggatcctactacaacccgtcactcaacgagtcgactttaccatatcactccgacacgtcagaatcagttctcctgaaactgagtcgtcattgtcgcggacacacgccgtactacttagttgtntacagganactccggaccctagtaactcgggacttcccggccccgttcgggggccccggtaaaccctggtccaccggttctacccgtcacgccctacccgaccgaacgggcccctagtcccggtcctttacccccgnggcccacccttccacccgagaccg

SEQ ID NO: 337357 - DNA, 727 bp, Homo sapiens
  misc_feature: GZ8MTXP02J4P4M.11.85.H08.1.454.CMB.2.raw
  modified_base (177)..(177): a, c, t, g, unknown or other
  misc_feature (177)..(177): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttnacagacgctgtccctcacctgcaatgtctcggatctccatcaccgatactgtattactactggtctttgggactccgacacgtcccgaggaggctggagtgctggtangccacanagaggactcccttanaccaaccgtnactanagagtctacttaccatactcacgtccgacacgtccaggtaatcctagtttccaccctagtaaaccgtggaacgggtcctcgtacgtttcgccggacggacctacgaacgggtcccgtttattaaatttagtttggtacgggttaccaggtacggaacgttcccccggggaccctacgttaaccgcgggggtcccgttcccgggggccccccggttaaacggggggcccccggggtaaaccccgttggggtttacccccgtaccccggtcccttacccgtacccgtacccgtaccccgtaccccgtaacccggtaacccgggtaccccgtacccgttccccggttccccgttcccccgtaccccggtaccccgtaccccgtaccccgtacccgtaaccggtaccgg

SEQ ID NO: 337358 - DNA, 608 bp, Homo sapiens
  misc_feature: GZ8MTXP02GJUUC.11.85.H08.1.454.CMB.2.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (401)..(401): a, c, t, g, unknown or other
  misc_feature (401)..(401): n is a, c, g, or t
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtcccgagggaggcctggagtggcttggtatcgtaccaccanaggaggactccctactaccaacccgtnactacaagagtccgacttacatancactccgacacgtcaaggaactcagttcctaccctagaaactgacgtccgntattgcgacggacacacgcccgttataactttagtgtcgtacagacgtacgtacccggaccctaagtaaccgttcgggcccgttccccggcccccgggttaccgggggacccccggtaaccgtcgggtacccgtacccgtctcccgtccacgtccctaccaaccgacggcccagtcccgtctccccgtgcccnccctcnccganccg

SEQ ID NO: 337359 - DNA, 610 bp, Homo sapiens
  misc_feature: GZ8MTXP02IBAJW.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtcccctcacctgcaatgtctccggagtctccatcaccgatactgattactactggctttggatccgacacgtccccgagggaagggcctggagtggcttggttatgtccaccacagagggactccttactacaacccgtcactcaaagagtcgacttaccatatcactccgacacgtccagaatcagtctcctagaaactgagtcgtcattgtcgcggacacacgccgtctattatttagtgtacagtaagactacccgggtccccaataaaccgtggccgtccggcccccggtacgggggccccggggaaccccgttcggtccgacccgtcctcctccgacgtcccctacccaaccgaaccgggaccccacgttcggtcccctttcccccgtcggccacccccttaccctaccaacggtacg

SEQ ID NO: 337360 - DNA, 598 bp, Homo sapiens
  misc_feature: GZ8MTXP02GNP1B.11.85.H08.1.454.CMB.2.raw
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgttcctcacctgcaatgtctccggagtctccatcaccgatactgattactactggctttggatccgacagtccccagggaagggcctggagtggcttggttatgtccacacagagggatcccttactacaacccgtcactcaagagtcgacttaccatatcactcgacacgtcaggatcagttcnccctagaaactgagtccgtnattcgtcgcggacacncgccgtctatttatcgtgtcagagactccggccctataacgtcggactccgggaccccgtcgggggccccgggaaccctcgggtacccacccggtctccctccgacggcccctacccgaccaaacggggccccctagtcccgggtccttccccccgtggacccctaccccgtcccttcccgaaacgtcccg

SEQ ID NO: 337361 - DNA, 652 bp, Homo sapiens
  misc_feature: GZ8MTXP02FV760.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccgaggggagggcctggagtggtcttggttatcgtccaccacgagaggtactcccttactaccaacccgtcactacaagtacgtacgtacttaccatactcactccgaccaccgtacaggtaactcctacgttcctacctagtaaacctgtacggtcccgtactacgttcgtacgcggtacacgacgtcccgttactagtttatgttgtacagacgactcccggaccctagtaaccgtcggaccgtcccggccccggtacgggggtaccccggtaacccgtggtacccgaccgttccctccgtccgacgtcccctccgaacccgtaaccgggccctacgttcccggtcccgttcccccgtcgtccccgaccccctccgtacccaacgacccg

SEQ ID NO: 337362 - DNA, 633 bp, Homo sapiens
  misc_feature: GZ8MTXP02IZME5.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaaggcctggagtggcttggtatgtccaccacagaggactccttacaccaacccgtcactcaagagtcgacttaccatatcactccgacacgtccaggaatcagttcctccctagaaactgacgtccgtcattgtcgcggacacagccgtactattattgtgtacagagactcccggacctaagtaacctcgggacctcccgggcccccgtcgggggacccccgggtaaacccgtcgggtacccgacccggtcctcccgtccgaccgtcccctacccgaacccgaaccggggccccctaacgttccccgggttcccctttcccccccgtcgggtcccctacccccgttccctacccgaaacggtacccg

SEQ ID NO: 337363 - DNA, 692 bp, Homo sapiens
  misc_feature: GZ8MTXP02HO305.11.85.H08.1.454.CMB.2.raw
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccgagggaggcctggagtggcttggttatgtccacanagaggactcccttactacaacccgtnactcaagagtcgacttaccatatcactccgacacgtcaaggatcagttcctcctagaaactgacgtccgtatagttgtcgcggacacgtacgcccgttataatttattgtagtcaaggtacgtaccgttcccgggaccccttaaagttaaccgtgggaccccgtcccggggtacccccggttcggggggacccccggggtaaaccccgttcggggtaccccgtacccggtcccttacccgtaccgaccggtcccccttacccgaaacccgaaacccgggggtccccctaacgtttccccgggttccccctttccccccggttcgggaccccctaacccccgtttcccaaccccgtaaaaggtcccccg

SEQ ID NO: 337364 - DNA, 651 bp, Homo sapiens
  misc_feature: GZ8MTXP02JTI6Q.11.85.H08.1.454.CMB.2.raw
  modified_base (635)..(635): a, c, t, g, unknown or other
  misc_feature (635)..(635): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctcggatctcatcacgatactgtattactactggtcttggactccgacgacgtcccgagggacggcgtggagtggtcttggtatcgtaccacgacgaggacggtacctaccttactaccgaaccgtacactacaagtacgtacgtacttacatactcactaccgaccacgtacacgtactcgtacttcctaccgtagtaacgtcgtacgtcgtatacggttacgcggacctacgacgacgttccgttattagttacgttgtacgacgtacgacggtccctccggaaccttacgtacgggccgggttcccgccccgggggtacccgggtacggggacccccgtacgtcgtaccccgtccgtacctccgaccgccgtacccgccgaaccggtcctccccgtccgtccccgtcccgcctacccgcctaacccncgtaaacgacggtccg

SEQ ID NO: 337365 - DNA, 606 bp, Homo sapiens
  misc_feature: GZ8MTXP02IS7Z3.11.85.H08.1.454.CMB.2.raw
  modified_base (389)..(389): a, c, t, g, unknown or other
  misc_feature (389)..(389): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
tcagcgagagataccacgaccggtgctcgatttagtatcactcagtcgcggggtcctggacctcctgtgcaagaccatgaaacacctgttgttcctcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacagtccccagggaaggcctggagtggcttggttatgtccaccacagagggactcccttactaccaacccgtcactcaagagtcgacttacatatcactcacactcagatcagttctcctagaaactgacgtcgtnattgtcgcgacacagccgtntattattgtntacagagacttccggaccctagtaaccgtggtaccgtccggcccccgtcgggggtacccccgggaacccgttcgggtaccgacccgttccgtccctacgtaccgcccttcccgaaacccgacggggcccctaacgtccgggttcccttcccccgtggacccctacccccgtcctacccgaacgaccg

SEQ ID NO: 337366 - DNA, 668 bp, Homo sapiens
  misc_feature: GZ8MTXP02JGYUN.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccgagggaaggcctggagtggcttggtatgtccacacagagggatcccttactaccaacccgtcactccaagacgtcgacttaccatatcactccgacacgtcaggatcagttctccagaaactgacgtctacattgtcgcggacacagccgtctattattgtgtacagagtatcccggaccctagtaaccgtcggacctccgggcccccgtcgggggacccccgggtaaaccttcggggtaccctacccgggttccctcccgttacgacccggtccccttaaccccgaacccggaaaaccgggggtccccctaaacggtttcccccgggggtccccctttacccccccggttcgggacccccgtaaacccccccgtttcccaaacccccggttaaacgtaacccccgg

SEQ ID NO: 337367 - DNA, 559 bp, Homo sapiens
  misc_feature: GZ8MTXP02FXDE5.11.85.H08.1.454.CMB.2.raw
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaggcctggagtggcttggttatgtccacacagaggatcccttactacaacccgtcactcagagtcgacttaccatatcactcacactcagatcagttcnccctagaaactgagtccgtnattgcgcggacacacgccgtactattattgtgtacaganacgtccggacccatactcgggcctacccggcccgtacggggccccggtaaccgcggtaccaccgtctccgtcacgcctcccgacacgggcccacgtccggtccttccccctggcccacccctcctccaacgtaccg

SEQ ID NO: 337368 - DNA, 746 bp, Homo sapiens
  misc_feature: GZ8MTXP02F61T2.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctccggagtctccatcaccgatactgtattactactggtctttggactccgacacgtccccgagggaggctggagtggcttggtatcgtccacacaggaggtactccttaacaccaacccgtcactacgaacgtacgtaccgaacttaccatactcactcccgaacctaccgtacaaggtactaccgttacgttcctcccgtaagtaaaccgtcggtacgttccgtacgtaacttcgggtacggaccggaactaacgtacggtacccgtttacttaaacgtttctttacggtacgttacgaaggtaacgtaccgttaccccgggaaccctaaacgttaaccggttccgggtacccgtccccggggtacccccggggttccgggggtacccccgggtaacccgttcgggtacccctacccggttcctcccgtacgaccgtacccccacccgaacccggaaccgggcccctaccggttcccgtaaccccgttacccccgtccgggtacccaaccccccgtttaccgtacccaacggtaccccg

SEQ ID NO: 337369 - DNA, 676 bp, Homo sapiens
  misc_feature: GZ8MTXP02J29WX.11.85.H08.1.454.CMB.2.raw
  modified_base (606)..(606): a, c, t, g, unknown or other
  misc_feature (606)..(606): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatccaccgatactgattactactggtctttggactccgacacgtcccgagggaaggctggagtggtcttggtatcgtccaccacgaggacggtacttaccccgttaactacccaacccgtcaacctacgaaacgtacgtaccgtaaccttaccatactccactcccgaacctaccgtaccgaaggtaactccgtaacgttcctacccgtaagtaaaccgtggtaacgttccgtactacgttccggtaccgacggaacctacgtacgtccgttacttaattgttcggtacgtacaggtacgacgttccccggactaactacggtcgggtcccgtcccggtcccccgggtcgggggacccccggtaccgtcggtacccgtacccgtcctccncgaccgccctaccaccgacggccctacgtcccgtcccttaccccgcgccctacccgcctaccgacgcccg

SEQ ID NO: 337370 - DNA, 748 bp, Homo sapiens
  misc_feature: GZ8MTXP02IFYUV.11.85.H08.1.454.CMB.2.raw
  modified_base (330)..(330): a, c, t, g, unknown or other
  misc_feature (330)..(330): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggactccgacacgtcccgaggggacggcctggagtggcttggttatgtccacagagaggactcctacacacccgcactacaagngtacgtacttacatactcactacccgacaccgtacaaggtaactccgtaacgttcctaccctagtaaacctcggtaacgttcccgtactacgttcgtccggaccggtaaccaccgtacggtacccgtttacgttaacttttagtttaggttcgttacgaaggtaaacgtacttacccgaacgtacccctaaagttaaccggtcggtcccgtaccccggggtacccccgggtcggggggtaccccccgggtaacccgttggggtaccccctaaccccgggtttccctaccccgttccgaaccggttacccccacccggaaccccggtaaacccgggtcccctaaaccggttccccgggtttcccccgtttaccccccgtcggaccccctacccccgtttcccgtaacccgtaaacccgg

SEQ ID NO: 337371 - DNA, 636 bp, Homo sapiens
  misc_feature: GZ8MTXP02IHYU1.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccgagggaacgggcctggagtggcttggttatgtccacacagagggatcccttactacaacccgtcactcaagagtcgacttaccatatcactccgacacgtcaggatcagttcctccctagaaactgacgtccgtactattgtcgcggacacgagcccgtacttattacttgtcgtacagtacgacgttcccggaccctaagtaaccgttcgggccttcccgggcccccggttcgggggacccccgggtaacccgttcgggtacccgtacccggtccctaccctccgaaccgtcccctacccgaacccgaacgggcccctaacgttcccgggtcccttcccccgcggcccacccctcccgtacccaacggacccg

SEQ ID NO: 337372 - DNA, 586 bp, Homo sapiens
  misc_feature: GZ8MTXP02IBC88.11.85.H08.1.454.CMB.2.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccaggaaggcctggagtggcttggtatgtcaccacagnggatccttactacaacccgtnactcaagacgtcgacttaccatactcactccgacacgtccaggaactcagttcnccctagaaactgagtccgtnattcgtcgcggtacacagtcccgtacgtactttattgtgtcagagagttcccggccctaataacgtcggccgttcccggccccgtcggggcccgggtaaccctggtccaccggtcctcctcacggccctccaccgacgggcccacgtcccggtccttaccccccgtggcccctacccgtccctaccaacgaccg

SEQ ID NO: 337373 - DNA, 904 bp, Homo sapiens
  misc_feature: GZ8MTXP02IQIFP.11.85.H08.1.454.CMB.2.raw
tcagcgagagataccacgaccggtgctcgatttagtatcactcagtcgcggggtcctggacctcctgtgcaagaccactgaaacacctgttgttcttcctcctgctggtggcagctcccaaatgggtcctgtcccaggtacacctggtggagacgggcccaggactggtgaagccttcacagacgctgtccctcacctgacaatgtcgtccggagtctccatcaccgatactgtattactactggtctttggatccgacacgtccccgagggaacgggtcctggaggtggtcgttgggttacgtcggtacccaaccgacgtaaggacgggtacttaccccgtttaacgtaacccgaaccccggtccaacctaccgaaacggtacggttacccgtaaacctttaacccgaattactaccaaccgttaccccgaacctaacccggttaccaaacggggtaaacttaccgtaacggtttccctaccccgttaaaggtaaaaccgttcgggtaaaccgggttcccgtacgttaacgtttcggtaccgggaccggtaaccaccgtacggtacccgttacgtttaagttttaacgtttggtacggttaccgaaagggtacgttaccgttaccccggggaacccttaaagttaaacccgttcggggaccccgttcccggggaccccccgggtttacggggggaccccccgggttaaacccggttccgggttacccgtaacccccggtttcccgttaccccgtccggtaaaccggtcccccttaaaccccggaaaccccggtaacccgggggtacccccttaacgggtttcccccgggttaacccccgtttccccccggacggggttaccccctacccccgtttaccccgtaacccgtaaacggtacccccg

SEQ ID NO: 337374 - DNA, 649 bp, Homo sapiens
  misc_feature: GZ8MTXP02GFRXU.11.85.H08.1.454.CMB.2.raw
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttgggttatgtccacacagagggactcccttactacaacccgtcactcaagagtcgacttaccatancactccgacacgtccaggaatcagttctcctagaaactgacgtccgtnattgtcgcggacacagcccgtctattattgtgtcagtacgatcccggaccataaccgtgggcctacccgggtccccggtacgggggacccccgggtaaacccgtcgggttacccgacccggttccctccccgttacgaaccggcccccttaacccgaaccccggaaacgggggtcccccaacggtttccccgggtccccttttcccccccgaggtccccctaacccccgtcccttaacccgaaacgtacccgg

SEQ ID NO: 337375 - DNA, 664 bp, Homo sapiens
  misc_feature: GZ8MTXP02G75JY.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggatccgacacgtccccagggaagggcctggagtggcttggttatgtccaccacagagggactcccttactacaacccgtcactcaagagtcgacttaccatatcactccgacacgtcaggatcagttcctcctagaaactgacgtctctattgtcgcggacacgagcccgtactattagttgtcgtcagagactcccggaccctaagtaaccgtgggtaccgtcccggggcccccgtacgggggacccccgggtaaccccgttcgggtaccccgtaacccggttccttccccgtacgacccgtccccctacccgaaaccccggtaaaccggggccccctaacgttccccggggttcccctttcccccccggacggtccccaaccccccgtttcccgtaccccgaaacgtacccccgg

SEQ ID NO: 337376 - DNA, 691 bp, Homo sapiens
  misc_feature: GZ8MTXP02GJ2JI.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcacgatactgattactactggtctttggatccgacacgtccccgagggacggctggagtggcttggttatgtccacacagaggactccttacaccaacccgtcactacaaagtacgtcgtacttacatactacactccgacacgtaccaaggactctacgttcctacctagaaactgtacgtccgtactagttcgtccgacggacaacgtacggtcccgttacttagtttaacttggtacgttacaaggtacgtaccgttacccggaccctaagttaacccggtcgggtcccgttccccggccccgggtaccgggggacccccggtaacccgttcggacccgtacccgtcctcccgtaccgaccggacccctacccgaacccggtaacccggggtccctacggttccccggttaaccccgttcccccgtacggtaccccctaacccccttcccgaacccgaacggtaccccg

SEQ ID NO: 337377 - DNA, 694 bp, Homo sapiens
  misc_feature: GZ8MTXP02GZVC8.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccagggaggcctggagtggcttggtatgtccacacagaggactcccttacacaacccgtcactcaagagtcgacttaccatatcactccgacacgtccaggactcacgttcctacctagaaacgtgtacggtccgtctagttcgtccgacggacacgacgtccgttactagttattcgtgtacaggacgacgttcccgggaccctaattaaccgtcgggtacccgtcccggggtcccccggttccggggggacccccggggtaaaccccgttcgggtaccccgtaaccccgggttccctaccccgttcccggaaccggtcccccttaccccggaaacccgtaaccgggggtccccctaacggtttccccggggttccccttccccccggttcgggacccctacccccggttccctaacccgaacgtaaccccgg

SEQ ID NO: 337378 - DNA, 630 bp, Homo sapiens
  misc_feature: GZ8MTXP02FQRK0.11.85.H08.1.454.CMB.2.raw
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccgagggacgggcctggagtggcttggtatgtccacacagaggatccctactacaacccgtcactcaagacgtcgaccttacatatccactccgacaccgtacacggaatcacgttccnccctagaaaccgtgacgtctacatttcgtctcggacacncgcgttactatttatgtgacagtagactcccggactataacgtcgggtcctacccgggtcccgtaccgggggccccggtaaacccgtcgggtaccctaccgtcctccctaccgacgtccctacccgaaccgaaccgggtaccctacgttccccggtaaccctttccccccgtcggtaccccctaccccgtaccccgtaccgaacggaacccg

SEQ ID NO: 337379 - DNA, 577 bp, Homo sapiens
  misc_feature: GZ8MTXP02IUE1I.11.85.H08.1.454.CMB.2.raw
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatcgacacgtcccaggaaggctggagtggctggtatgtccacacagaggatccttactacaacccgtcactcaagagtcacttaccaatatcactccgacacgtcaagtaatcagttcnccctagaaactgagtaccgtcattgcgcggacacagccgtactattattgtnagagagacaccgacatacgtcgccgtccggcccgtcggggacccggaaccgtcggtacccgaccgtcctccctacgaccgccctaccgaaaccgaacggaccctacgttccccgtccgttcccccgtacgacccctaccctacccgtaccgaaacgacg

SEQ ID NO: 337380 - DNA, 602 bp, Homo sapiens
  misc_feature: GZ8MTXP02HV3KK.11.85.H08.1.454.CMB.2.raw
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
  modified_base (553)..(553): a, c, t, g, unknown or other
  misc_feature (553)..(553): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtctttggactccgacacgtccccgagggaacggctggagtggtacgttggttatggtccaaccacgaggagggacttacccttactaccaacccgtcacctcaaggagtccgtacttaccatactcactccgacacgtcagactcgagttcctcctagaaactgagtgctcatgtcgacgtacacgngtccgtacttattactgttntcagagacgtccgacctatacgcggcctccgggccccgtcgggggcccggtacccgtggtccctaccgtctcccgtcaccgccctaccgaccgaccgggaacccncggttcccggtcccttccccgcggtacccctccccgtccaccgtaaccg

SEQ ID NO: 337381 - DNA, 738 bp, Homo sapiens
  misc_feature: GZ8MTXP02H2PUH.11.85.H08.1.454.CMB.2.raw
  modified_base (355)..(355): a, c, t, g, unknown or other
  misc_feature (355)..(355): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcacgatactgattactactgtctttggatccgacacggtacccgaggggacggtccgtggagtggtcgttggttactcggtaccaaccgaacgaggacgggtaccttaccccttaactaacccgaaacccccgtanaacctacgaaacggtacgtaccgttaacttaacctaaagttactaccgtaaccgttaccccgaaccgtaccgtacccgaaaggggtaaactttccgaacgttttccctaccccgttaaagtaaaacccgttggtaaccggttcccgtacgttaacggtttcgaccggacggtaaccaccgtacgtcccgtttacttagtttagttagtcgtacgaagcggtaccgtccgacctaagtacgtggcccgtcggaccccgtggggacccccgtcgtaccgtcaccgtactccgtacgccgtacccaccgtacccgaacgggtccctaaccggtcccgtttcccgtcccccgttacgcccccgtacctaccccgtacctaacgaccg

SEQ ID NO: 337382 - DNA, 568 bp, Homo sapiens
  misc_feature: GZ8MTXP02HC81B.11.85.H08.1.454.CMB.2.raw
  modified_base (177)..(177): a, c, t, g, unknown or other
  misc_feature (177)..(177): n is a, c, g, or t
  modified_base (377)..(377): a, c, t, g, unknown or other
  misc_feature (377)..(377): n is a, c, g, or t
  modified_base (498)..(498): a, c, t, g, unknown or other
  misc_feature (498)..(498): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttnacagacgctgtccctcacctgcaatgtctccggagtctcatcaccgatactgattactactggctttggatccgacagtccccagggaaggcctggagtggcttggttatgtccaccacagagggactccttactacaacccgtcactcaagagtcgacttacatatcactccgacacgtccagaatcagttcctccctnaaactgagtcgtcattgcgcggacacagccgtacttattattgtgtacagagatcccggcctataactgggacctccggccccgtcgggggccccggaacctggaccaccgtctccgtacncgccctccaccgaacgggccccagtcccggtccttcccccgcggcccaccccgtacctcccgaagacccg

SEQ ID NO: 337383 - DNA, 702 bp, Homo sapiens
  misc_feature: GZ8MTXP02J1I0E.11.85.H08.1.454.CMB.2.raw
  modified_base (207)..(207): a, c, t, g, unknown or other
  misc_feature (207)..(207): n is a, c, g, or t
  modified_base (607)..(607): a, c, t, g, unknown or other
  misc_feature (607)..(607): n is a, c, g, or t
  modified_base (676)..(676): a, c, t, g, unknown or other
  misc_feature (676)..(676): n is a, c, g, or t
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtcnccggagtctccatcaccgatactgattactactggtcttggactccgacacgtccccgagggacggcctggagtggtcttggttatcgtccaccacgagagggactcccttaactaccgaacccgtcaactacaaagtagtacgtaccttacatactcactcccgaacctacgtcccaaggtaactcctagttccctacctacggtaaaacctggtaaccgggttcccgttagtacgtttcgggtaccggaccggtaaaccaaccgacggtccccgttattaactttacggttgtcgttacgaacggtacggtaccgttcccgggaccctaagttaacgtccggggtccgtcccgggcccccgggttaccgggggacccccggtaaccgtcgggtacccncccggttctcccgtacgaccgcccttaccgacccggtaacggccctaccgttccggtcccttcccccgngaccccaccccgtccaccgaacgccg

SEQ ID NO: 337384 - DNA, 625 bp, Homo sapiens
  misc_feature: GZ8MTXP02H5UYQ.11.85.H08.1.454.CMB.2.raw
  modified_base (425)..(425): a, c, t, g, unknown or other
  misc_feature (425)..(425): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggtcttggactccgacacgtcccgagggacggctggagtggcttggtatgtccacacagaggactcccgttacaccaacccgtcactacgaagagtacgtacctaccatactcactaccgacaccgtccaaggtatctacgttcctaccgtagaacgtgtacgtccgtatagttcgtcgcgacacncgtcccgtattatacgttgtctacagagtacgtccggctaatacgcggccgtccggggccccggtacgggggacccccggtaaccggtccggtacctacccggtcctacccgtcgaccgtccctaccgaccgaaccgggtccctacggtcccgttcccgttcccccgcggtacccctaccccgtccgtaccgaacgcccg

SEQ ID NO: 337385 - DNA, 604 bp, Homo sapiens
  misc_feature: GZ8MTXP02I5ZAD.11.85.H08.1.454.CMB.2.raw
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
  modified_base (573)..(573): a, c, t, g, unknown or other
  misc_feature (573)..(573): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggagtctcatcaccgatactgattactactggtctttggacttccgactacgtccccgaaggggaagggcctggagtggcttggttatcggtccaccacagagggtactccttactacaaccgtcactcaagacgtcgacttaccatatcactcgacacgtccaagactcacgttctcctagaaactgacgtctntatgtcgacgcaacngtcgtctattactgtntcagatacgtccggacctatacgtcgaccgttccggccccggtacgggggccccggtaaccgttcggacctaccggttctacccgtcgaccgtccctaccaccggtaacgggccctaagttcccggtccctttcccccgnggtccctaaccccgttccacctaacgggacc

SEQ ID NO: 337386 - DNA, 658 bp, Homo sapiens
  misc_feature: GZ8MTXP02H8O5D.11.85.H08.1.454.CMB.2.raw
  modified_base (399)..(399): a, c, t, g, unknown or other
  misc_feature (399)..(399): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtcctcacctgcaatgtctcgatctcatcaccgatactgattactagtgtcttggactccgacacgtcccgagggacggctggagtggcttggtatcgtccacacgaggtaggaccttacccttactaccaaccccgtacactacgaaagtacgccgtaactaccatactcactcccgacaccgtacaaggtactcgacgttccaccgtaanaaaccgttgaccggttccgtatactcggtccgacgactacgacgccgttattactttagttcggtacgtacagacgtaccgtacccggaccttaacgtacggtcggacccgttccgggaccccggtcgggggaccccgtacgttcgaccctaccgtcctaccgcgacccgtaccacccgaaccggaccggccctacgttccccggttccccgtccccgaacggtaccctacccccgtactacccgaaacggtaaccccg

SEQ ID NO: 337387 - DNA, 605 bp, Homo sapiens
  misc_feature: GZ8MTXP02I60P0.11.85.H08.1.454.CMB.2.raw
  modified_base (459)..(459): a, c, t, g, unknown or other
  misc_feature (459)..(459): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggatctcatcaccgatactgattactactggtcttggatccgacacgtccccgaggggaacggcctggagtggtcttggttatcgtaccaccacgaggacggtactacccttactaaccaacccgtcaactcaacgtagtcgacttaccatactcacctccgacaccgtacaaggtaactctacgttcctcctagaaactgacgtccgtatagttcgtcgacgacacacgtcttactattatgtcgtcaganacgtccggacctagtaccgtggaccgtccggacccgtcgggggacccggtaaccgtggtacctaccgttcctcctcgaccgtcccgtaccaccgtacggccctagtcccgtccgttccccctaggcccaccctctaccgaagtccg

SEQ ID NO: 337388 - DNA, 679 bp, Homo sapiens
  misc_feature: GZ8MTXP02FLC7U.11.85.H08.1.454.CMB.2.raw
  modified_base (392)..(392): a, c, t, g, unknown or other
  misc_feature (392)..(392): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactatggtctttggatccgacacgtccccgagggacggctggagtggcttggtatcgtccacacgagagggactccttactaccacccgtcactacaagacgtcgtaacttaccatatacctactcccgacaccgtacaaggaactcctaacgtttcccnccctaagaaaccgtggtacgttaccgttctaagtttcggtcggtaccggaacacgacggtcccgtttatactttagttcgtacgtacagtacgacgtcccggacctaataaccggtcgggtccgttccccgggccccggtacgggggaccccggtaccggtcggtccctacccgtaccctcgacccgaccgtcccctaccgaaacccggaccgggtccctacggttccccgtccccgttaccccgtccggacccccgttaccccgtccctaaccgaacggtacccgg

SEQ ID NO: 337389 - DNA, 726 bp, Homo sapiens
  misc_feature: GZ8MTXP02FJUVZ.11.85.H08.1.454.CMB.2.raw
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggctttggatccgacngtccccaggaggcctggagtggcttggtatgtccacacagaggntcctactaccaacccgtcactcaagagtccgacttaccatatcactccgacacgtccaaggaactcaagttccnccctagaaactgacggtccgtcatttcgccgaccggactacacgggtcccttacttatttaagtttcgtcgttacacggtacgtaacgtccccgggaccccctaagttaaacccgtcggggtacccgttcccccggggcccccgggttacgggggggaccccccgggtaaaccccggttcgggggtaccccctaaccccgggtccctttaccccgtccgtaaccggtcccccttacccgtaaacccggaaaccgggggtcccccctaacgtttccccgggggttcccccttttcccccccggcggggtaccccctaaccccccgtttcccgtaaccccggaaaaggtcccccgg

SEQ ID NO: 337390 - DNA, 712 bp, Homo sapiens
  misc_feature: GZ8MTXP02G5W18.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatcctccatcaccgatactgattactactggtctttggatccgacacgtccccgaaggggacggcctggagtggtcgttggttatgtccacacgaggaggactccttacacaacccgtcactcaagacgtcacttaccatactacactccgacacgtccgaagtactcgtaacgttcctacctagtaaacctggtacgttccgtactattcggcgaccggtacaccgaacgtcccgttacttaagtttatttcgtacgtacgtaacggaacgtaccggttaccccggaccccgtaaaagttaacccgggtcgggtcccggtaccccgggtcccccgggttacggggggtaacccccccgggtaaccgttccgggtaccccgtacccgttcccgttacccgtcgtaacccgtcccctacccgaacccggtacccgggacccctacggtccccgttcccgtacccccgtcggtaccccctaccccgtccgtaccaacggtcccg

SEQ ID NO: 337391 - DNA, 668 bp, Homo sapiens
  misc_feature: GZ8MTXP02HIARX.11.85.H08.1.454.CMB.2.raw
  modified_base (426)..(426): a, c, t, g, unknown or other
  misc_feature (426)..(426): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctcatcaccgatactgattactactggtctttggacttccgactcgtcccgagggacggcctggagtggtcttggtatcgtccaccacgaggacggtactccctttacacctaacccgtcaactcgaaagtacgtacgtaacttaccaatactaccactcccggaacaccgtaccaggtaactcagttcctacctagaaacgtgacgtccgtntacgtcgtcgcggacgtacacgtccgtacttatttacgttcgtcgtacaggacgtaccgtcccggtaaccaacttaaccggcgggtcccgttcccgggaccccgggttcccgggggaccccggtaaccgttcgggtaacctcccccggttcttcccacgcccgtccctaccgaaccgacccgggtcctacgtcccggttcccttacccccgcgtacccctaccccttccgaacgtacgcccg

SEQ ID NO: 337392 - DNA, 749 bp, Homo sapiens
  misc_feature: GZ8MTXP02I6NFB.11.85.H08.1.454.CMB.2.raw
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcatgtctccggagtcctcatcaccgatactgtattactatggtctttggactccgacacgtcccgaagggacggcgtggagtggcttggttatcgtccacacgagaggtactccgttactaccaaccgtcactacgaagacgtctaaccttactatactacctactaccccgaacgtaccgtaccgaacggtaactaccgtaacgtttccctacccgtaacgaaacgttacggtaccgggttaccgtacgtacgttcgggtaccgacccggaacctaacggtaaccgtccccggtttaatttaagtttaggtttacgtacggttaacgaaggtaaacggtacccgttcccggaaccctaaagttaacccggtccgggtaccccgtcccggggtcccccgggtaccggggggtaccccggtaccccttcgggggtaccctaccccggttcccttacccggcgaacccgtccctacccggaaccggaccggtacccctacggttccccggttccctaccccgtgaccccctcccgaccgtaccgaacacccg

SEQ ID NO: 337393 - DNA, 561 bp, Homo sapiens
  misc_feature: GZ8MTXP02FK280.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggccagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaggcctggagtggcttggtatgtccaccacagaggatcctactacaacccgtcactcaagagtcgacttaccatatcactccgacacgtccaggaatcagttctccctgaaactgagtccgtcattgtcgcggacacagcccgtctattattgtgtcagagatccggcccagtaactggctccggccccgtgggggccccggaaccctggtccacccgtctccgtcagccctccaccctaacgggcccccatccggtcctttcccccgcggccaccccgtccctccgaacgaccg

SEQ ID NO: 337394 - DNA, 661 bp, Homo sapiens
  misc_feature: GZ8MTXP02JMVPM.11.85.H08.1.454.CMB.2.raw
  modified_base (465)..(465): a, c, t, g, unknown or other
  misc_feature (465)..(465): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctccggagtctccatccaccgatactgattactactggtctttggactccgacacgtccccgaggggaacggcctggagtggtcttggttatcgtccaccacgaggaggactcccttactaccaacccgtcactacaagagtcgacttaccatactcactccgacaccgtacaaggtaactctacgttcctacctaagtaacctggacgttccgtactacgttagtccgacgtacaacgcgtcccgttatgtttattgtntacgagacgtccgtacccggactagtacgttcggccgtacccggccccgggtccgggggacccccgggtacccgtccgggacccgtacccgtccttcccgaccggtaccgtccccacccgaaccggaccggccccttaccgtcccggtcccgttcccccgcggaccccctacccgtccccgtacgaaccgtacccg

SEQ ID NO: 337395 - DNA, 737 bp, Homo sapiens
  misc_feature: GZ8MTXP02JJ85C.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactgttgaagccttcacagacgctgtccctcacctgcaatgtctccggatctccatcaccgatactgtattactacgtgtctttggactccgacacgtccccgagggaacggtctaggagtggtcttgggttatcgtccacgacgaggacggactcccttaactaaccaacccgtcactacaagtacgtacgtaacttacaatactcactacccgacacgtacaaggtactctaacgttcctacccgtaagtaaaccgtggtacggttacccgtactacgtttacggtccgaccgggtaacacgtaccggtaccccgttatttaaaccgtttagtttcggtagttaccgaagtacggtacgttaccccgggaccctaagttaaccgtccgggacccgttcccgggtacccccgggtacgggggtacccccggtaaacccggttcgggtacccgtacccgttcccttacccgtcgacccgtacccctaacccgacccggaaaccgggtcccctacggttccccggtttccctcccccggtcgtacccctaaccccgttcccaaccgaacgtacccg

SEQ ID NO: 337396 - DNA, 673 bp, Homo sapiens
  misc_feature: GZ8MTXP02FL14N.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactacttggtctttggatccgacacgtccccgaaggggaaggcctggagtggtcttggttatggtaccaccgacgagagggacttccttactaaccacccgtcactacgaagagtacgacttacatatcactccgactacgtcaaggtactcacgtttcctaccctagtaaacgtcgacgtccgtactagttcgtacgcggtacacgacgtccgttactatttacgttgtgtacgacgtagaccgtcccggaccctaagtaaccgtcgggacccgtccggggacccccggtccgggggacccccgggtaacccgttcggtaacccgcccgttcctacccgtcaccggtccccttacccggaccgtaaccgggacccctcgttccccggttcccgttcccccggtcggtaccccctacccgtaccgtaccgaacggtacccg

SEQ ID NO: 337397 - DNA, 665 bp, Homo sapiens
  misc_feature: GZ8MTXP02JE325.11.85.H08.1.454.CMB.2.raw
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacacgtccccaggggaaggcctggagtggcttgggttatgtccaccacagaggatccttactacaacccgtcactcaagacgtcgacttaccatactcactccgacacgtcagatcattctcctanaaactgaggtcctnattcgtcgcgacacgagccgtactattacttgtgtacaggagtacttcccgggacctagttaaccgtcgggacccgtcccgggcccccggtcgggggacccccgggtaacccgttcgggtacccgtacccggtccctcccgtaccgtaccggaccccgttacccgaaacccggtacggggtaccccctaacggttccccggttaaccccgtttcccccccggtacgggtcccccctaccccttacccgtaaccccgtaaaccggtaaccccgg

SEQ ID NO: 337398 - DNA, 712 bp, Homo sapiens
  misc_feature: GZ8MTXP02HLX8J.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaacgccttcacagacgctcgtccctcacctgcaatgtctcggatctccatcaccgatactgaattactacgtggtctttggactccgacgacgtcccggagggaacgggcctggagtggcttggtactcgtaccaccagaggtacggtacctacccttactaccgaaccccgtcacgtacaagacgtacgacttaccattactcacgtccctaccaccgtaccgaaggtaactcctacgtttccctaccctagtaaacctcgtaccgttccgtctgttcgcgccggactacgcgtacccgttattagtttagttcgtagttacaggtaaccgaccgttcccggacccctaaagttacccggttcgggaccccgtcccccggggtacccccgggggtcccgggggtaacccccggggtaccgttcggtccccgtacccggttccctcccgtccctaaccggcccccttaccgaaccccgtacggcccttacggttcccgtccccgttccccggacgtcccctaccctaccccacgtaacgcccg

SEQ ID NO: 337399 - DNA, 752 bp, Homo sapiens
  misc_feature: GZ8MTXP02H2ZKS.11.85.H08.1.454.CMB.2.raw
  modified_base (332)..(332): a, c, t, g, unknown or other
  misc_feature (332)..(332): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctcggatctcatcacgatactgattactacgtgtcttggactccgacacgtcccgagggaggccgtggagtggtcgttggttatcgtccaaccgagaggacggacttacccttaactaccaacccgtnacctacaacgtagtaccgtaacttacaatactaccactacccgacctaccgtacccaaggtacttcgtacgtttccgtaccccgttaaagtaaaaccgttcgggaaccggtttcccgtactttaacggttccgttacccggtaccggtaaaccgaccgttaacggtacccccgtttatttaaacgtttacggttttacggtaccggttacgtaaacggtaccggtaaaccgttcccccggggtaaacccttacgttaaaccgggttcgggtcccgtaccccggggtcccccggtaccgggggtacccccggtaaccggttccggtacccgtcccgtcctcccgtaccgaccgtccctaccgaccgaccgccctacgtcccgtcccttcccgaccgtccctccctacccgacgtaacgccg

SEQ ID NO: 337400 - DNA, 699 bp, Homo sapiens
  misc_feature: GZ8MTXP02I0LO5.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgtattactactggtctttggactccgacacgtaccccgagggacggccgtggagtggtcttggttatcgtaccaccgtacgaggaggacttcccttaacaccgtaacccgtacactacgaagtacgtaccgtaaccttaccaacttactaccactaccccgacctaccgtaccgaaggtaaactctacgtttccctaccctagtaaactgtacggtcctactattcgcgacggacacgacgtccttgttattattgtacgtacagtacgtacgtcccggtaacctaacgttacgtccgggaccgttccccggggaccccggttacgggggacccccgggtaaccgttcggtacccgaccccgtactcccgtaccaccggtccctaacccgaccggaaccgggtcccctacgtccccgggttccccttccccggaccgtccccgtacccctcccgtaccctaacggccccg

SEQ ID NO: 337401 - DNA, 603 bp, Homo sapiens
  misc_feature: GZ8MTXP02HBF8B.11.85.H08.1.454.CMB.2.raw
  modified_base (256)..(256): a, c, t, g, unknown or other
  misc_feature (256)..(256): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
tcagcgagagataccacgaccggtgctcgatttagtatcactcaggtcggcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccganagtcccaggaggcctggatgctgtatgtccacanagaggatcctactacacccgtnactcaagagtcgacttaccatatctactccgacacgtaccaggtaatcagttctcctagaaactgaacgtcgtcattcgcgccggacaccgagcccgtattattagttcgtagttacagaggtacttcccgggccctaagtaaccgttcgggactccggtccccgtgggggccccggtaaaccttggtaaccgacccgttcgtccctacgacggcccttaccgaccgtaacggggcccacgttccggtaacccttcccccgtggccctacccgtcctacccgaaagtcccg

SEQ ID NO: 337402 - DNA, 620 bp, Homo sapiens
  misc_feature: GZ8MTXP02IRL4O.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtcctccatcaccgatactgattactactggctttggatccgactacgtccccgaggggacggcctggagtggtcttggtatgtccacacagacggtatccctactaccaacccgtcactacaagagtcgacttaccatatcactccgacacgtccagatcacgttcacctagaaactgacgtcgtcattcgtcgcggacacgacgcctacgtattatgtcgtacaggagactccggccctaagtactcgggcctcccgggccccggtgggggacccccggtaaccgtcggtaccctaccgtccctccgtcacgtaccccgtaccgaacccgtaaccggggccctacgttccccggtcccgttccccccgtacggtcccctacccccgtaccctaccgaaaacgtcccg

SEQ ID NO: 337403 - DNA, 565 bp, Homo sapiens
  misc_feature: GZ8MTXP02J0AJR.11.85.H08.1.454.CMB.2.raw
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (474)..(474): a, c, t, g, unknown or other
  misc_feature (474)..(474): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgttcctcacctgcaatgtctccggagtctccatcaccgatactgattactactggctttggatccgacagtccccagggaggcctggagtggcttggttangtccaccanagagggatcccttactacacccgtcactcaagntcgacttaccatatcactccganacgtccaggaatcagttcnccctgaaactgacgtctcattgtcgcggacacagcccgtctacttattgtgtcagagatccggcccataactggcctcggccccgtggggcccgggtaacccngggtccaccggttctcctcacgccctccgacccgtaacgggccctactccgggtcctccccccgtggcccaccctcctacccgaacgaccg

SEQ ID NO: 337404 - DNA, 646 bp, Homo sapiens
  misc_feature: GZ8MTXP02HAWKV.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggtagctcccaaatgggtcctgtcccaggtacacctggtggagacgggcccaggactggtgaagccttcacagacgctgtccctcacctgcaatgtctccggagtctccatcaccgatactgattactactggtctttggactccgacacgtccccgagggacggcctggagtggtcttggttatcgtccaccacgagaggactccccttactaccaacccgtcactacgaagagtacgacttaccatactacactcgaccaccgtccaaggaactcacgttcctcccgtacgtaaactcggacgtccgtactagttcggtccgcgaccacgacggtccgttacttatttcgttgtagtacagtacgtacgtcccggaccctaagtacgtcggacccgtccggcccccgtcgggggacccccgggtaacctcgggtccctaccggtcctacccgtcacgtccctacccgaccgacggacccctacgtccggttccctccccgcggacccctccctaccaccgaacgaccgtaacccgg

SEQ ID NO: 337405 - DNA, 696 bp, Homo sapiens
  misc_feature: GZ8MTXP02GZWNR.11.85.H08.1.454.CMB.2.raw
  modified_base (476)..(476): a, c, t, g, unknown or other
  misc_feature (476)..(476): n is a, c, g, or t
  modified_base (576)..(576): a, c, t, g, unknown or other
  misc_feature (576)..(576): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcaacagacgctcgtccctcacctgcaatgtctccggatctccatcaccgatactgattactacgtggtctttggactccgactacgtccccgaaggggaacggccgtgggagtggtctttggttatcgtcccaccacgagaggactccttactaccaacccgtcactcaagcgtacgtacttacgattactacactaccgaccacgtaccaaggaactcgtacttccgtaccctaggaacctgaccggttccgtacgtagtttcgcgacggtacacgcgtcccgttacttagttattggnttaccgagtacgtaccgacccggtaccctaagtaccgttcgggacccgtccccggggtaccccgggccgggggtacccccggtaacgttcccgggtaccncccgggttcccttcccgtacccacggtcccccgtacccgaaaccggaccgggtcccctcggttccccgttccccgttacccccgttcggcccccttacccgtccccgtaccgaacgcccg

SEQ ID NO: 337406 - DNA, 676 bp, Homo sapiens
  misc_feature: GZ8MTXP02GMY43.11.85.H08.1.454.CMB.2.raw
  modified_base (498)..(498): a, c, t, g, unknown or other
  misc_feature (498)..(498): n is a, c, g, or t
  modified_base (590)..(590): a, c, t, g, unknown or other
  misc_feature (590)..(590): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgtattactactggtctttggactccgacacgtccccgaagggaggcctggagtggcgttggttactcggtaccaccgacgaggaggtacttccccgttactaccaacccgtcactacgaagacgtaccgtaacttaccatactctaactcccgaacctaccgtaccaaggtaactctaacgttcctacccgtagtaaaccgtcgaacggttcccgtatacttcggtcgaccggacaacgtcggccgttattacttagttcggtcgttanacggtacgaccgtcccgggacctagtaccgtcgggtaccctccccgggccccggtcgggggtacccccggaacttcgggacctcccggtacncccgttcaccgtccccgtaccgacggaccgtccctaacgttcccggtccctaccccgtcggccctaccccgttaccacgaacgccg

SEQ ID NO: 337407 - DNA, 715 bp, Homo sapiens
  misc_feature: GZ8MTXP02GFJ5G.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggtctttggatccgacagtccccgagggagggctggagtggcttggttatgtccacacgagaggactcccgttactaccaacccgtcactcaagacgtcgacttacatactcactcgacacgtacaaggatctacgttcctaccagtaaactcgacgtcctcatttcgcgacggacacgcgtccgttacttactttagttcgtgtacgaagtagacgttcccggacctaacgtaaccgtcgggtcccgtccccgggtcccccgggtaccgggggtacccccgggtaaacccgttcggggtaccccctaaccccggttccccgttaccccgtccgtaccggtacccccgttaccccgaaccccggtaaacccggggtcccccgtaaccggtttacccccgggttcccccgtttcccccccggttacgggccccccgttaaccccccttaccccgttaaccccgaacggtaacccccgg

SEQ ID NO: 337408 - DNA, 648 bp, Homo sapiens
  misc_feature: GZ8MTXP02G5HZM.11.85.H08.1.454.CMB.2.raw
  modified_base (273)..(273): a, c, t, g, unknown or other
  misc_feature (273)..(273): n is a, c, g, or t
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgacaatgtctcggatctccatcaccgatactgattactatggtctttggactccgacacgtcccgagggacggcnggagtgcttggtatgtccacacaggaggtactcccgttaactaccaacccgtacactacaagacgtacgacttacatatacactaccacactcgagactctacgtcctaccagtaaactgtacgtccgtatacgttacgtcgacggacacgagcccgttattattattgtgtacagtagacgtaccgactaataacgtcggacccgtccggccccggtacgggggaccccggtaaccgtcggtcccgtaaccgttccctaccgttaccaaccggtccccttaccgaaaccccggtaacgggtacccctaaccggtcccggttaacccccttcccccggtacggtacccctaccccgtaccctaccgaacgacccg

SEQ ID NO: 337409 - DNA, 640 bp, Homo sapiens
  misc_feature: GZ8MTXP02FGAOS.11.85.H08.1.454.CMB.2.raw
  modified_base (192)..(192): a, c, t, g, unknown or other
  misc_feature (192)..(192): n is a, c, g, or t
  modified_base (554)..(554): a, c, t, g, unknown or other
  misc_feature (554)..(554): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaatgggtcctgtcccaggtacacctggtggagacgggcccaggactggtgaagccttcacagacgctgtccctnacctgcaatgtctccggatctccatcaccgattactgattactactggtctttggactccgacacgtccccgagggaacggcctggagtggtcttggtatcgtccaccacgagaggtactcctactaccacccgtcaactcaagagtcgacttacatatccactcccgaccacgtccaaggatccacgtttctaccctagaaaactcgtaagtccgtcacgtttacgtcgaccgggaacacgtacgcccgttactaattattgtgttcagacggcttcccggccctagtaaccgtcggcgtcccgggccccggtcggggacccccgggtaaccctcggtacccgtcccgtcccgttaccccnccgaccgtcccgtacccgacccgaccggtcccctaccggttccccgtcccgtccccgtaccggtccccaccccgtccaccgacgcg

SEQ ID NO: 337410 - DNA, 667 bp, Homo sapiens
  misc_feature: GZ8MTXP02GYZZS.11.85.H08.1.454.CMB.2.raw
  modified_base (274)..(274): a, c, t, g, unknown or other
  misc_feature (274)..(274): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggacgtggtgaagccttcacagacgctgtccctcacctgcaatgtctcggatctcatcacgatactgtattactactggtctttggatccgacacgtcccgagggaacggtccnggtacgtggtcttgggttatcgtcccacctagacggaaggtccttccttaacgacctaacccgtacaactcgaagtacgtcctaacctttacatacactactaccgaacaccgtacaggtaatccgacgtttccacccgttaagaaaccgtcggtaaccgttccgatacgttcgtcgacgacaacgacgtacgtacttaagttagttcgtagacgagaaacgtcgttacccggacctaaatacggtccggaccttcccgggggacccttcgggggacccccgtaacgttcgaacccgtccgtctcccacgaccttcccgaccgacgaacccggtccctacggtcccggttaacctccccgacgacccttaccccacctaacgaaacgtacccg

SEQ ID NO: 337411 - DNA, 646 bp, Homo sapiens
  misc_feature: GZ8MTXP02IWGO9.11.85.H08.1.454.CMB.2.raw
  modified_base (482)..(482): a, c, t, g, unknown or other
  misc_feature (482)..(482): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccgagtctccatcacgatactgattactatggtctttggatccgacacgtccccgagggaacggcgtggagtggcttaggttatgtccacactaggaggtactacccgttactaccaacccgtcaactacaaagtacgtccgtaacttaccaatactacaacctccgaacctaccggtacctaaggaactacgtacgttcctccctagtaaaacttcgaacggttccgtactagttcgtcgcggtaacacgcgtccgtcttattagttgtacgtanacgtagacgtccggacctactacgtcggacctcccgggcccggtcggggaacccccggtacgtccggtcgacccgtctccgcgtacgccctaccgaaccaccggggtccctacggtcccgtcccgttccccggcgacccctaccctacccacgaaccgtaaccg

SEQ ID NO: 337412 - DNA, 684 bp, Homo sapiens
  misc_feature: GZ8MTXP02GFZW4.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctcgtccctcacctgcaatgtctccggagtctccatcacgatactgtattactactggtctttggactccgacacgtccccgaagggacggcctaggagtggtcttggttatcgtaccaccagagaggactccttaactaccaacccgtcactacgaagacgtacgacttacatactcactaccgactaccgtacaaggtaactctacgttcctacctagtaaacgtggtacgttccgtactacgtttcgtaccggaccggacacgacgtcccgttattactttattgtcacgagacgtccgtccggacctaataccggtcggtcccgtacccgggccccggtacgggggacccccggtaaccgttcgggtaccctacccggttcctcccgtaccgaccgtaccccgtacccgaacccggtacgggtccccctaggttcccccggttaacccgttcccccggacgtaccccacccccgtttacgacccgtaaacgacccg

SEQ ID NO: 337413 - DNA, 635 bp, Homo sapiens
  misc_feature: GZ8MTXP02GO3P4.11.85.H08.1.454.CMB.2.raw
  modified_base (295)..(295): a, c, t, g, unknown or other
  misc_feature (295)..(295): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (490)..(490): a, c, t, g, unknown or other
  misc_feature (490)..(490): n is a, c, g, or t
  modified_base (587)..(587): a, c, t, g, unknown or other
  misc_feature (587)..(587): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccaggaagggcctggatggctggttatgtccaccanagagggatcccttataccaaccgtcactcaagagtcgaacttaccatatcactccgacaccgtcacggaatcagttctccctgaaactgaacgtccgtcattgcgcggcacngcgtcttattagttngtcngaagatcccggcccataaaccgtgggccgtaccggtcccccgcgggggtaccccgggaaccccncgggttccgacccgtccgtaccctcgaccggtacccctcccgaacccccgtaaacgggacccccgtacgttaccgggttcccccgttttaccccccnccgggggtacccccaacccccgtacccttacccgaacgtaaaacccgg

SEQ ID NO: 337414 - DNA, 756 bp, Homo sapiens
  misc_feature: GZ8MTXP02G3O2N.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcatgtctccggatctcatcacgatactgattactactggtctttggactccgactacggtccccgagggacgggcctggagtggcttggttatgtccacacagaggactcccttacacacccgtcactcgaagagtccgtacttaccatactcactcccgactacgtaccaaggactcacgttcctcctagaaacgttcgacggttccgtatattcgtcgcggaactacgacggttcccgtatttaactttagtttcgggtaacttccgaaaggtacgtaaccggtaccccggggtaacccttaaaggttaaacccgttacggggtacccgttaccccgggggtcccccggttaccgggggggaccccccggtaaaccccgttcggggttaccccgtaaaccccgtttccttaccccgttcggacccgtaccccgttacccgaaacccggaaaccggggtcccctaaaccggttcccgggtttaacccccgttaccccccggttccgggaccccctacccccggttacccctttaaccgaaccggtttaaaaccccgg

SEQ ID NO: 337415 - DNA, 954 bp, Homo sapiens
  misc_feature: GZ8MTXP02H3JQ4.11.85.H08.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacggcccaggactgggtgaacgccttcacagacgctgtccctcacctgcaatgtctcggatctccatcaccgtatactgtattactactgtctttggactccgacacgtccccgagggaacgggcctggagtggcgttggttancgtccaaccgacaggagggactcccttacacctaaccccgtnactacaagtacgtacgtaaccttacatactaccaccgtccgaaccgtaccgtacgaagtaactccgttaacgtttcctaccctagtaaaccgtggtaaccgttccgtactagtttcggtaccgacggaaccctacggacccgttcccgtttaacctttaagttttacgttacggttacgttaccgaaacgggttaaacggtaacccggttacccccgggtaaccctttaaaacggttaaacccccggtttacgggggtaccccccggtttacccccgggggtccccccccgggggttaacccgggggggttaacccccccccggggggttaaaaccccgtttcccgggggtttaacccccggtaaccccccggggtttaaccccccgtttcccccggttaaccccggttaaaaccccggggttccccccccgttaaaacccccggggttaaaaacccccggggaaacccccgggggtttaacccccctttaaccccgggggtttacccccggggtttccccccctttaaaccccccccggggtttacggaccccccccggtttaaaccccctttacccccccggtaaacccggtttaaaaaccccgggtacccccgg

SEQ ID NO: 337416 - DNA, 763 bp, Homo sapiens
  misc_feature: GZ8MTXP02IK3JC.11.85.H08.1.454.CMB.2.raw
tcagcgagagataccacgaccggtgctcgatttagtatcactcagtcgcgggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatccaccgatactgtattactactggtactttggactccgacacgtcccgagggaggcctggagtggcttggtatgtccacacaggacggtactcccttaactaccaacccgtcactacaaggacgtccgtaacttaccaatactacactccgaaccaccgtccgaaggtacttccgtaacgtttccccgttcccgtaaggtaaaaccttgggaccggtttaccgtacgttagtttcgtaccggaccggtaacaccggtacggtacccgttacctttaaagttttacgttggttacgtacaagaacggtaccgtccccggaacccttagtaaccggtgggtaccccgtccccgggacccggtccgggggacccccgggttaacccgtcgggtaccccgtacccgtccttccccgtaccgtacgtccccttacccggaaacccggtacccggggtaccccgtaacgttccccggggtttccccctttccccccggttaccgggtacccccttaaccccgttccccctacccggtaaaacggcccccg

SEQ ID NO: 337417 - DNA, 680 bp, Homo sapiens
  misc_feature: GZ8MTXP02IWIFH.11.85.H08.1.454.CMB.2.raw
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactgggtgaagccttcacagacgctgtccctcacctgcaatgtctcggatctcatcacgatactgattactatgtctttgactccgacncgtcccgagggaggctggagtgtcttggtncgtaccacagagaggtactccttacacacccgtcactanaacgtacgtacgtactaccatactacactaccgaccacgtcgaagtactcgtacttccacctagaaacgtgacgtctctagttcgcgacgacacgacgttaccgtcttacgtttattcgtacgtacagtacgtacccgttcccggactaacgttacgtcgggcccgttacccgggcccgggtaccgggggacccccggtaaccggttcgggtacccctaccggttccctaccgtccgtacccggtacccctaacccggaaccggtacccgggtaccccctacggtttccccggttcccccgtttcccccggtaccggtacccctttaaccccctcccggttaaacccaaccgggttcccg

SEQ ID NO: 337418 - DNA, 850 bp, Homo sapiens
  misc_feature: GZ8MTXP02HWB99.11.85.H08.1.454.CMB.2.raw
  modified_base (194)..(194): a, c, t, g, unknown or other
  misc_feature (194)..(194): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgtctgtccctnacctgctaatttcgcggtatctccatcgaccgtatactgtacttactacgtggtcttggactccgaacacggtccccgagggacggtccgtggagtggtcttaggtatcgtaccaccgaacgaggtacggtacttaccccttaacgtaacccgtaaccccgtacaaccgtacgaaaggtacggttaccgtaaactttacctaaacttaacgtacccgtaacgtacccgtaaccctaccggttaacccgaaagggtaaacctcgttaaccgtttacccgtccccgttaaggaaaaccgttcggtaccggttccgtactacgtttacgggtaccggacgtaaccgacgtacggtcccgttattacgtttagttcgtacgtaccgtagtacgaccggtccccggtaactaacgttacgtccgggtacccgtccccgggtcccccgggttacgggggaccccccggttaaaccggtccgggttaacccccgtaccgggtcccccttacccggggttaaccccgtacccggtacccccgtaacccggaaccccgggtaacccggttaccccgttaacccggttccccggttacccccgttaacccccggtacccgtaaccccttacccccgtacccgtaacccgtaacggtacccgtcccg

SEQ ID NO: 337419 - DNA, 729 bp, Homo sapiens
  misc_feature: GZ8MTXP02JL5N4.11.85.H08.1.454.CMB.2.raw
  modified_base (345)..(345): a, c, t, g, unknown or other
  misc_feature (345)..(345): n is a, c, g, or t
  modified_base (435)..(435): a, c, t, g, unknown or other
  misc_feature (435)..(435): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctccatcaccgatactgattactactggtctttggactccgacacgtccccgagggaacgggcctggagtggtcttggttatcgtccaccgacaggagggtactcccttaactaccaacccgtcactacaagngtacgacttacatatcactccgacacgtcaggaactcgtacgttcctaccgtagaaacgtcgacgttccgtctattcgcgacggacacgngtccgtatacttgttcgtgtcgagacgacgttccggaccctagtaaccgtcgggtacccgtacccgggccccggtccggggggtacccccggtaacccgttccgggttaccccgtaaccccggttcccttaccccgtaccgtaaccgtcccccgtaaccccgtaaaccccgggtaacccgggtacccccgtaaccggtttccccggttcccccgtttaacccccccggtttccgggaccccccttacccccgttaccccgttaaacccccggtaaacgggttaaaaccccccgg

SEQ ID NO: 337420 - DNA, 560 bp, Homo sapiens
  misc_feature: GZ8MTXP02GT970.11.85.H08.1.454.CMB.2.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (453)..(453): a, c, t, g, unknown or other
  misc_feature (453)..(453): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcaccgatactgattactactggctttggactcccanacgtccccgagggaacggcctggagtggcttggtancgtacaccanagaggactcccttacacaaccgtcactcaagacgtcgaacttacatatcactcgacactcagatcattcctcctaagaaactggaacggtcctactaattgtcgcggaacacgaggtccctataattatcgtagacagacgattccggacctanaacgtggccgtaccggcccgtggggccccggaactggtaccaccgtctcctcgacgcctacacgtacgccaatccggaacttccccgagccaccctctacgagaccg

SEQ ID NO: 337421 - DNA, 706 bp, Homo sapiens
  misc_feature: GZ8MTXP02ILNSJ.11.85.H08.1.454.CMB.2.raw
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
  modified_base (461)..(461): a, c, t, g, unknown or other
  misc_feature (461)..(461): n is a, c, g, or t
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggccaggactggtgaagccttcacagacgctcgtccctcacctgcaatgtctccggagtctcatcaccgatactgattactacgtggtcttggactccgacacgtacccgagggaaggcctaggagtggctggttactcgccgacacgaggnggtactaccctaacaccaaccgtnactacgaagacgtaccgtaactaccaagtactccaacgtcccgacaccgtacgaggtaacncgtattccctcccgtaagaaacgtcgaacgttccgtactgttcgtaccgccggaacacgacgtcccgttntaaagtttcgtcgtagtccgtaagacgtaacgtccccggaacttaacgtaaccgttggggaccctcccggggtccccgggttaccggggcccccgggtaaacccgttggcccgttacccgtccgtttacccgtcgaacccggttcccaacccggtaaacccgtaccgggtacccgtccgtttccgttaacccccgttcccggaccgtccccctaacccctcccggtaaacgacccgtaaaccggg

SEQ ID NO: 337422 - DNA, 732 bp, Homo sapiens
  misc_feature: GZ8MTXP02GKMQE.11.85.H08.1.454.CMB.2.raw
tcagcgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggatctcatcaccgatactgattactactggtctttggactccgacacgtccccgagggacggcctggagtggtcgttgggttatcgtacccaacctacgaaggacgggtacttaccccgtttaacaaccctaaccccggtctaaccgtacaaaacggtacgtaccgtaaaccttacctaattaactaccaaccttacccgaacctaaccgttaccgaaacgggtaaacttaccgtaacgtttcccgtacccgtaacggtaaaaccgttcggaccggttaccccgtataacggtttcgacccgggtaccgaaccgtaaacgtacgtcccgtttaaccttagtttaaccgttgggtacctacgaagtagtaccgttacccggacctaaatacgtcgggccaccccgggtcccggtcgggggaccccgtaaccgtcgtaccgaccgtcctccgtacgaccgtcccacaccggtaacgtcccacgtccgtcccttccccgagtacccacccgttcaccgacgaaccg

SEQ ID NO: 337423 - DNA, 562 bp, Homo sapiens
  misc_feature: GZ8MTXP01BHFWB.17.53.E09.1.454.CMB.2.raw
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggccncgccttagggtcgactcaccctgccccgattaacgtgacagaccttggctcggngagcggctttcaccgnttatcgttactatgtcagcaattcgnacttctgactacctcagccatgcctcacagcacaccttcacagctacagaacccncctacccaaccaacacncanacgcgtcnctcgccgcncgcgtcgttcgtcttacgttcgttacgttcccgttccttcctccttcccgtcctctcttctaacgttcgtcg

SEQ ID NO: 337424 - DNA, 566 bp, Homo sapiens
  misc_feature: GZ8MTXP01DRY86.17.53.E09.1.454.CMB.2.raw
  modified_base (347)..(347): a, c, t, g, unknown or other
  misc_feature (347)..(347): n is a, c, g, or t
  modified_base (491)..(491): a, c, t, g, unknown or other
  misc_feature (491)..(491): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgttcccatcgactacgcttcggctcgctagggtcactcaccctgcccgatacgtgacagaccctgtctcggngagcggctttcaccgtcttatcgttactatgtcagctaacttcgcacttctgactacctcagcatgcctcacagcacaccttcaacagctacaacgaaccgctaccccctaaccaaacaaccgcataagccgtcgcctcgcgcncgtcgtcgttgtcgttacgttcgttacgttcccgttccttctctccttcccgtcctacttctcgttaacgtaacg

SEQ ID NO: 337425 - DNA, 604 bp, Homo sapiens
  misc_feature: GZ8MTXP01EFO5Y.17.53.E09.1.454.CMB.2.raw
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgtggacaggaacccttggtcttccggcgagcgggtcttttcgaccgtctttatcgttaccttatgtcagcaattcgctacttcngactacctccancatcnctcacacacactacctacacacgtactacacgaacgaccgtacccctaacccaaccaaccgacaactaacgtacgtcgtctcgccgcgcgtcgttcggttcgtcgttacgttcgttacgttcccgttccttcctctccttcccgtcctacttctcgttaacgtaacg

SEQ ID NO: 337426 - DNA, 618 bp, Homo sapiens
  misc_feature: GZ8MTXP01ANXWW.17.53.E09.1.454.CMB.2.raw
  modified_base (478)..(478): a, c, t, g, unknown or other
  misc_feature (478)..(478): n is a, c, g, or t
  modified_base (530)..(530): a, c, t, g, unknown or other
  misc_feature (530)..(530): n is a, c, g, or t
  modified_base (543)..(543): a, c, t, g, unknown or other
  misc_feature (543)..(543): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatacgccttctcccgtcccccttgcagtaacaccaagtacagaatattaacctgttcccatcgactacgcctttcggcctcgccttaggggtcactccaccctgccccgtattaacgttgacaggaacccttggtcttccgggcgagcgggtctttcgacccgtctttactcgttaccttatgtcagcaattcgctacttctgactacctcgactcatcgcctcacacgcacaccttcacacgcttaacacgaaccnccctacccctaacccaaaccaaccgcaataacgccgtacgcctcgccgtacncgtcgttcggttntcgttacgtttcggtttacccttccccgtttcttaccgttccctcccgtcctactcgttacgtaaccgttcgtcg

SEQ ID NO: 337427 - DNA, 599 bp, Homo sapiens
  misc_feature: GZ8MTXP01APUL6.17.53.E09.1.454.CMB.2.raw
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttagggtcgactcaccctgccccgataacgttgacaggaacccttggtcttccggcgagcggggtctttcgacccgtcgtttatcgttacttatgtcagcaattcgcacttctgactacctcagcatcgcctcacacgcaaccaccttcacacggtacttaacacgaaaccgcctacccctaacccaaacaaccgcaactaacgccgtcgctggcccgcacgcttcggngtcncgttcgggttacgccccgttttcacttccttcccgctactccgttgtaaccttaaggtcc

SEQ ID NO: 337428 - DNA, 613 bp, Homo sapiens
  misc_feature: GZ8MTXP01BY2LL.17.53.E09.1.454.CMB.2.raw
  modified_base (180)..(180): a, c, t, g, unknown or other
  misc_feature (180)..(180): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaaccggacaaccgtcgcccggcaacatagccttctccgtccccccttgcagtaacaccaagtacaggaatattaacctgtttcccatcgactacgccttcggcctcgccttaggggtcactcaccctgccccgattacgtgacaggacctgtcttccggngagcggctttcaccgtntttatcgttactatgtcagctaattcgctacttcngactacctcagcatcgacctcacacgcacctaccttcacacggcttaacgacgaacccgtcctaccccctaacccaaacaaccgtcaacgtaacgcgtccgctcgacccgtcaggtcgttacggttgaccttagtttccgggtttacgttcccccgttttcacctttcccttccccgctacgtcttacgtaaccgttaacggttccg

SEQ ID NO: 337429 - DNA, 588 bp, Homo sapiens
  misc_feature: GZ8MTXP01D95F6.17.53.E09.1.454.CMB.2.raw
  modified_base (468)..(468): a, c, t, g, unknown or other
  misc_feature (468)..(468): n is a, c, g, or t
  modified_base (523)..(523): a, c, t, g, unknown or other
  misc_feature (523)..(523): n is a, c, g, or t
  modified_base (544)..(544): a, c, t, g, unknown or other
  misc_feature (544)..(544): n is a, c, g, or t
  modified_base (555)..(555): a, c, t, g, unknown or other
  misc_feature (555)..(555): n is a, c, g, or t
  modified_base (566)..(566): a, c, t, g, unknown or other
  misc_feature (566)..(566): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgccggcaacatagccttctcccgtcccccttcgcagtaacacaagtacaggaatattaacctgttcccatcgactacgcttcggcctcgctaggggtcactcacctgccccgattaacgtggacaggaacccttggtcttccgggcgaggcgggtcttttcgaccgtctttactcgttacttatgtcagctaattcgctacttctagactacctcagcatgcctcacagcaacaccttcacagtcttacacgaaccncctacccctaaccaaacaacgcaactaacgcgtacgctcgccgtcagcctttggngccttaagttcgggtttaccnccccgttttcncttcccttccncttactcttacgtaacttcgtc

SEQ ID NO: 337430 - DNA, 588 bp, Homo sapiens
  misc_feature: GZ8MTXP01CTXSP.17.53.E09.1.454.CMB.2.raw
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (466)..(466): a, c, t, g, unknown or other
  misc_feature (466)..(466): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
  modified_base (556)..(556): a, c, t, g, unknown or other
  misc_feature (556)..(556): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgttcccatcgactacgcctttcggcctcgccttaggggtcactccaccctgccccgattaacgttggacaggaacccttggtcttccggcgaggtcgggctttcgacccgctttatcgttacttatgtcagcaattcnctacttctgactacccncagcatcgcctcacagcacaccttcacaggccttanacgtaaccgcttacccctacccaacaacgcataacgcgtacnctgcccgcacggtcttcggntccttagttcggtttacgccccgttttnactcccttaccgcctatcttgtaacttggtcc

SEQ ID NO: 337431 - DNA, 564 bp, Homo sapiens
  misc_feature: GZ8MTXP02IJ7YS.17.53.E09.1.454.CMB.2.raw
  modified_base (381)..(381): a, c, t, g, unknown or other
  misc_feature (381)..(381): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggcactcaccctgccccgattaacgtggacaggaaccccttggtcttccggcgagcgggtctttcacccgntttatcgttactatgtcagcattcgctacttctgactacctcagcatgcctcacagcacaccttcacagctacagaacgcctcccctaccaacaacgcactaagcgtacgctgccgcacgcttcggtgcctagtcggtttacgccccgtttcactccttcccgccactcctcgactacgtccg

SEQ ID NO: 337432 - DNA, 597 bp, Homo sapiens
  misc_feature: GZ8MTXP02HSFI0.17.53.E09.1.454.CMB.2.raw
  modified_base (375)..(375): a, c, t, g, unknown or other
  misc_feature (375)..(375): n is a, c, g, or t
  modified_base (465)..(465): a, c, t, g, unknown or other
  misc_feature (465)..(465): n is a, c, g, or t
  modified_base (558)..(558): a, c, t, g, unknown or other
  misc_feature (558)..(558): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaaacatagccttctccgtcccccttcgcagtaacaccaagtacagaatattaacctgttccatcgactacgccttcggcctcgccttagggcactcaccctgccccgataacgtggacaggaaccctggtcttccggcgagcggtctttcgacccgtnttatcgttaccttatcgtcagctattcgctacttctgtactacctcagcatcgcctcacagccacaccttcacaggcttaacacgaaccncctacccctaacccaacaaccgacagtaaagccgtacgctcgcccgcacggtccttccggtgcctaagttcggtttaaccgcccccgttttanacttccgtttccccacctactcctcgaactttacgtccg

SEQ ID NO: 337433 - DNA, 572 bp, Homo sapiens
  misc_feature: GZ8MTXP02H9083.17.53.E09.1.454.CMB.2.raw
  modified_base (532)..(532): a, c, t, g, unknown or other
  misc_feature (532)..(532): n is a, c, g, or t
  modified_base (542)..(542): a, c, t, g, unknown or other
  misc_feature (542)..(542): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgccttcggcctcgccttaggggtcactcaccctgcccccgattaacgttggacaggaaccccttggtcttccggcgagcgggcttttcacccgtctttatcgttaccttatgtcagcatttcgctactttctgataccctccagccatgccctcacagcacaccttcacagctacagaacgcctacccctaccaacaacgcataagcgtcgctgccgcacgcttcggtgctagtcggtttacnccccgttttnacttccttcccgacctatctcgactacgtc

SEQ ID NO: 337434 - DNA, 591 bp, Homo sapiens
  misc_feature: GZ8MTXP02I1OHV.17.53.E09.1.454.CMB.2.raw
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgccttcggcctcgccttaggggcactcaccctgccccgattaacgtggacaggaacccttggtctccggcgagcggctttcaccgtctttatcgttacttatgtcagtcatttcgctacttctgacttaccctcagcatgccctcacagccactacccttcacacggacttacacgaaaccgcctaccccctaaccaaccaacgacaataacgcgtcgctcgccgcacgtcgttcggtcgctacgttcggtttaccgccccgtcttaccaacttcccttcccgccactcctacgtaccttacg

SEQ ID NO: 337435 - DNA, 557 bp, Homo sapiens
  misc_feature: GZ8MTXP02HKMN2.17.53.E09.1.454.CMB.2.raw
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagcgtagactagcacgaccggtgctcgatttagagagagtgtgttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgttcccatcgactacgccttcggcctcgccttaggggtcactcaccctgccccgataacgtgacaggacccttggctcggcgagcggctttcaccgtntttatcgttaccttatgtcagcattcgctacttcngtactaccctccagcatgcctcacagcacaccttcaacngctacagaccgctcccctaccaacacgcataacgcgtcgctcgccgcacgcttcggtgctacgttcggttacgcccctttnactccgttccccnctactctacgtacttacgtc

SEQ ID NO: 337436 - DNA, 618 bp, Homo sapiens
  misc_feature: GZ8MTXP02G75OG.17.53.E09.1.454.CMB.2.raw
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgccttcggcctcgccttaggggtcactcaccctgccccgattaacgtggacaggaacccttggcttccggcgagcgggtctttcgacccgtcttactcgttaccttatgtcagcattcgctacttctgactacctccagcatcncctcacacncactacctacacacgtactacgacgaaccgccctacccctaacccaacaaccgactaactaacgccgtcgcgtcgacccgacgacgtccgttcggtcgtacgtacgttcggtttacccgtccccgtttactaccttcccgttcccgacctacttccgtacgtaaccgttacgtaccg

SEQ ID NO: 337437 - DNA, 602 bp, Homo sapiens
  misc_feature: GZ8MTXP02FYOA8.17.53.E09.1.454.CMB.2.raw
  modified_base (464)..(464): a, c, t, g, unknown or other
  misc_feature (464)..(464): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgccttcggcctcgccttaggggcactcaccctgccccgattaacgttggacaggaacccttggtcttccggcgagcggctttcacccgtctttatcgttaccttatgtcagcattcgcacttctgactacctcagcatcgcctcacagcacacccttcacagcttacacgaaccncctaccccctaaccaaacaacgcaactaaagcgtacgctcgaccgcaacgccgttcggtgcgtaagtttcggtttaacccgtcccccgttttctaacttcccttccccgactactccttacgacctttacggttcccg

SEQ ID NO: 337438 - DNA, 574 bp, Homo sapiens
  misc_feature: GZ8MTXP02F9GHH.17.53.E09.1.454.CMB.2.raw
  modified_base (375)..(375): a, c, t, g, unknown or other
  misc_feature (375)..(375): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
  modified_base (537)..(537): a, c, t, g, unknown or other
  misc_feature (537)..(537): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttgcagtaacaccaagtacaggaatataacctgtttcccatcgactacgcctttcggcctcgccttaggggtcactcaccctgccccgattaacgtggacaggacccttggcttccggcgagcggcttttcacccgntttactcgttacttatgtcagcattcgcacttctgactacctcagcatgcctcacancacaccttcacagacttacagaaccncctacccctaccaacaacgcataacgcgtcgctcgccgcacgtccttcggngctagttcggtttaacgtcccccgtttnaactccgtttccccgctactcgtacgacttacgtacg

SEQ ID NO: 337439 - DNA, 583 bp, Homo sapiens
  misc_feature: GZ8MTXP02G1A01.17.53.E09.1.454.CMB.2.raw
  modified_base (373)..(373): a, c, t, g, unknown or other
  misc_feature (373)..(373): n is a, c, g, or t
  modified_base (387)..(387): a, c, t, g, unknown or other
  misc_feature (387)..(387): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
  modified_base (518)..(518): a, c, t, g, unknown or other
  misc_feature (518)..(518): n is a, c, g, or t
  modified_base (548)..(548): a, c, t, g, unknown or other
  misc_feature (548)..(548): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgacttaaaccgggacaaccgtcgcccggccaaacatacgccttcctcccgtccccccttgcagtaacacaagtacagaatattaacctgttccatcgactacgcctttcggcctcgccttagggtcactcaccctgccccgatacgtgacaggaccttgctcggcgagcggctttcgaccgtnttactcgtacttangcacgctattcgctacttctgactacctcagcatcgacctcaacagcactaccttcacagtactacaacgaccgacctccccaaccaacaacaccaaactaacnccgtccncgtcgccgcgacgtcgtcgntacgtacgttacggttaccgtccccgtttnaccttccgtcccgactactcgtacgtactacgtcg

SEQ ID NO: 337440 - DNA, 593 bp, Homo sapiens
  misc_feature: GZ8MTXP02GO25P.17.53.E09.1.454.CMB.2.raw
  modified_base (182)..(182): a, c, t, g, unknown or other
  misc_feature (182)..(182): n is a, c, g, or t
  modified_base (280)..(280): a, c, t, g, unknown or other
  misc_feature (280)..(280): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagcgtagactagcacgaccggtgctcgatttagagagagtgtgttgggtttggggtacgatttgatgttacctgatgcttagaggcttttcctggaagcagggcatttgttgcttcagcaccgtagtcgcctcgtcatcacgcctcagccttgattttccggatttgcctaggaaaaccngcctacacgcttaaaccgggacaaccgtcgcccggcaaacatagccttctcccgtcccccttgcagtaacacaagtacaggaatataacctgttccancgactacgcttggcctcgcttaggggtcactcaccctgccccattaacgtgacaggaacccttggcttcggcagcgggtctttcgacccgtntttactcgttacccttangtcagcattcgactcttcgtanactccncancangacacacanacacacctacanacgtactacacgacgaccctacccaacccaaccaacgacaacgaacgacgcgcgcgaccgacgacgtcgtcgtacgtacgtacgttacggttaccgttacccgttactactccgttcccgtaccgtactacgtacgtacgtacgtacg

SEQ ID NO: 337441 - DNA, 554 bp, Homo sapiens
  misc_feature: GZ8MTXP01ARCHX.11.81.H04.1.454.CMB.2.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangcccaccctctcctgcagggccagtcagagtgttagcaacacttagcctggaccagcagaacctggccaggctccaggctcctcatctatggtncatccacgagggccacgtggtacncccgagccgaggttcaggtcggctaggtggggtctggggaacaggtcgttccacgtctcaccatcaagcacgcctgactagtctagtaagtatttgtacgttagtttttactgtacacggtctaagttatagtaactcggtcctccgttactcgtttcgggccgtacggggaccaagtacgttaagaaacttacgaaacgtacttggttcggctgcaactactcttcgtcttctaac

SEQ ID NO: 337442 - DNA, 531 bp, Homo sapiens
  misc_feature: GZ8MTXP01D1OGW.11.81.H04.1.454.CMB.2.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccacctctcctgcagggccagtcagagtgttagcaaacaacttagcctggtaccagcaagaaacctggccaggctcccaggctcctnatctatggtncatcccaccgagggccactggtactcccagccaggttcaggtcggcaggtgggtctggggaacaggngttcactctcaccatcagcagcctgcagtctagaagtatttgacttagttttactgtcaggtctagtatagtaactggcctcgtactacgtttgaccgaggggaaccaagcttaagaaattacgaaacgtaacttgttcggctgcaacctatcttgtcttctaac

SEQ ID NO: 337443 - DNA, 626 bp, Homo sapiens
  misc_feature: GZ8MTXP01BYIXZ.11.81.H04.1.454.CMB.2.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcaacaacttagcctggtaccagcaagaacctggccaggctcccaggctccncatctatggtncatccaccgagggccacgtggtactcccagccaggttcaggtcggctaggtgggtctggggaacagtgttcactctacaccatcagcacgcctgctagtctagtaagttagttttgtacgtttagtttttacgtgttacgtaggtacgtaagttaagttaacgttaacgttcggtcccgttaccgttaaccgttaccgttttccgggaccgtaacgggggtaaccctaaaggtaacgttaaacggtaaaacttaccgtaaaaacggtaacgttgggttcggaccgttaacggacctaacccgtattccgttacgttccgtttccgtaaccg

SEQ ID NO: 337444 - DNA, 527 bp, Homo sapiens
  misc_feature: GZ8MTXP01ALGAH.11.81.H04.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacacttagcctggtaccagcagaacctggccaggctccaggctcctnatctatggtncatcccacgagggccacgtggtactccccgagcctaggttcaggtcggcaggtgggtctggggaacagtcgttcactctcaccatcagcagcctgcagtctagtaagtatttgtcttagttttactgttcaggtctagtatagtacgtcgcctcgtactcgtttcggcgtacgggacaagcttaagaaacttacgaaacgtacttgttcgctgcaactatcttcgtcttctaac

SEQ ID NO: 337445 - DNA, 521 bp, Homo sapiens
  misc_feature: GZ8MTXP01EZJ14.11.81.H04.1.454.CMB.2.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (414)..(414): a, c, t, g, unknown or other
  misc_feature (414)..(414): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaaacaacttagcctggaccagcagaacctggccaggctcccaggctcctcatctatggtncatcccaccagggccactggtactcccgagccaggttcaggtcggcaggtggtctgggaacagngttcactcncaccatcagcagcctgcagtctagaagtatttgcttagtttttacngtcaggtctagtatagtaactggccttcgtactactttggcctaggggaccaagtccttaagaaacttacgaaacgtaacttgttggctgcaacatcttgtcttctc

SEQ ID NO: 337446 - DNA, 572 bp, Homo sapiens
  misc_feature: GZ8MTXP01DBM0S.11.81.H04.1.454.CMB.2.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggcctcccagataccactggagaaatagtgatgacgcagtctccagccaccctgtctgtgtctccgagggggaaangcccaccctctcctgcagggccagtcagagtgttagcaaacaacttagcctggtaccagcaagaaacctggccaggcctcccaggcctcctcatctatggtncatcccacgagggccactggtacncccagccaggttcaggtcggcaggtgggtctggggaacagtcgttcactcncaccatcagcagcctgcagtctagtaagtatttgtcttagttttactgtctaggtactaagttaataacgttaactcggtccttaccgttaaccttacgttttcggaccgtaacggggaacctaaagtacgttaaagaaacttacgaaaacgtaacgttaggttcggctcgacaactatcttagttcttctaac

SEQ ID NO: 337447 - DNA, 547 bp, Homo sapiens
  misc_feature: GZ8MTXP01A997F.11.81.H04.1.454.CMB.2.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (414)..(414): a, c, t, g, unknown or other
  misc_feature (414)..(414): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangcccaccctctcctgcagggccagtcagagtgttagcaacaacttgcctggtaccagcaagaaacctggccaggcctcccgagcctctcatctatggtncatccacagggccatggtatcccagccaggttcaggtcggcaggtgggtctggggaacagtgttcaactctacaccatcagcagcctgcagtctagaagtatttgcttagttttacngtacaggtctagtataagtaactcggccttacgtactcgtttcggaccgtaggggacctaagaccttaaggtaaacttcgaaaacgtacttggttagttcctaagcctaactatccttagttccttcgtaacc

SEQ ID NO: 337448 - DNA, 556 bp, Homo sapiens
  misc_feature: GZ8MTXP01BXWU9.11.81.H04.1.454.CMB.2.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (410)..(410): a, c, t, g, unknown or other
  misc_feature (410)..(410): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaaanaacttagcctgggtaccagcagaaacctggccaggctcccaggctcctnatctatggtncatcccaccagggcccatggtactcccagccaggttcagtcggcaggtgggtctggggaacagngttcaactctaccacatcagcagcctgcagtctagtaagttatttgnttagtttttactgttcaggtctagttatagtaactcggtacctcgtactcgtttcggaccgtaggggaaccaagacttaaagaaacttacgaaaacgtagttaggttcggactggacccaacctactcttacgttccgtttctaac

SEQ ID NO: 337449 - DNA, 558 bp, Homo sapiens
  misc_feature: GZ8MTXP01DOA9G.11.81.H04.1.454.CMB.2.raw
  modified_base (200)..(200): a, c, t, g, unknown or other
  misc_feature (200)..(200): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccacctctcctgcagggccagtcagagtgttagcaacaacttagcctggtaccagcagaaacctggccaggctccaggctctcatctatggtgcatcccgacaggggccaacgtcggtaatcccagcctagggttcaggtcggcgtagtgggtctggggaacagngttcactcncaccatcagcagcctgcagtctagagtattgtcttagttttactgtcaggtctagtatagtaacgtggtccttcgttactcgttttcggaccgtacgggaaccaaagtaccttaaaggaaacttacaaaacggtaacttcggttcggctgactaaccctattcttcgttcctttcgtaacc

SEQ ID NO: 337450 - DNA, 512 bp, Homo sapiens
  misc_feature: GZ8MTXP01D3WP7.11.81.H04.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (345)..(345): a, c, t, g, unknown or other
  misc_feature (345)..(345): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccacctctcctgcagggccagtcagagtgttagcaacaacttgcctggtaccagcagaactggccaggctccagctctcatctatggtncatcccacagggccatggtatccagccaggttcagtcgcagtgggtctgggaacaggngttcactctcaccatcagcagcctgcagtctagtaagtatttgcttagttttactgtctaggtctagtataagtactggcctccgttactacgtttggcctaggggaccaagcttaagaaacttacgaaacgtaacttgttcggctgcaaccatcttgtcttctaac

SEQ ID NO: 337451 - DNA, 503 bp, Homo sapiens
  misc_feature: GZ8MTXP01DIFWV.11.81.H04.1.454.CMB.2.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (400)..(400): a, c, t, g, unknown or other
  misc_feature (400)..(400): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactgganaaatagtgatgacgcagtctccagccacctgtctgtgtctccaggggaaangccaccctctcctgcagggccagtcagagtgttagcaacaacttagcctggtaccagcagaaacctggcagctccagctcctnatctatgtncatccacaggccactgtacnccagccaggttcagtcgctagtggtctgggaacagtgttcactctacaccatcagcagcctgcagtctagtagtatttgctagtttttacngttcaggtctagtatagtaactggcctccgtactctttggaccagggaccaaggtcaagaaacttagaaacgtacttgnggctgcaacatccttnttcttctc

SEQ ID NO: 337452 - DNA, 569 bp, Homo sapiens
  misc_feature: GZ8MTXP01DU6LA.11.81.H04.1.454.CMB.2.raw
  modified_base (199)..(199): a, c, t, g, unknown or other
  misc_feature (199)..(199): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacacttagcctaggtaccagcagaaactggccaggctccaggctcctcatctatggtgcatccacagggccatggtactcccagccagtcagtcgcagtggtctgggaacngtgtcactctacacatcancagcctgcagtctagtattagtttgacttagttttacngttctagttactagttaatacgttaacgtccggtacccttaccgttaaccgttacgttttacgggaccgtaacggggaacctaaagtacgttaaagtaaacttaacgaaaacgtacgttggttcggacttcgactaacgtacttccgttattaacttctaaccc

SEQ ID NO: 337453 - DNA, 606 bp, Homo sapiens
  misc_feature: GZ8MTXP01DOPEL.11.81.H04.1.454.CMB.2.raw
  modified_base (200)..(200): a, c, t, g, unknown or other
  misc_feature (200)..(200): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagacaaacaacttagcctgggtaccagacaagaaacctggccaggcctcccgaggcctcctcatctagtggtgcactcccaccgagggcccacgtggtaactcccagcctaggttcaggtcggctaggtggggtctggggaaacagtcgttcactctcaccatcagcacgctgctagtctagtaagttattttgtacttacgtttttactgtactaggtactaagttaataacgttaacgtcgtcccgttaccgttaacttacgtttcggaccggtaacgggacctaaagtaacgttaaagtaaacttaacgtaaaacgtacgttaggttcgttcgtcgacctaacctacttcttacgtttccttcgtaaccg

SEQ ID NO: 337454 - DNA, 532 bp, Homo sapiens
  misc_feature: GZ8MTXP01B41ID.11.81.H04.1.454.CMB.2.raw
  modified_base (200)..(200): a, c, t, g, unknown or other
  misc_feature (200)..(200): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (411)..(411): a, c, t, g, unknown or other
  misc_feature (411)..(411): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcaacacttagcctggaccagcagaactggcaggctcccagctccnatctatggtncatccacgaggccatggtacncccagccaggttcaggtcggctaggtgggtctggggaacaggtcgttcactctcaccatcagcagcctgcagtctagtaagtattttgcttagtttttacngttcaggtactaagttatacgtactcggtcctacgtacttcgttcggacgtacgggacaagtacaagtaaacacgaaacgtagttggttcgctcgcctaactactcttcgtcttcgtaacc

SEQ ID NO: 337455 - DNA, 553 bp, Homo sapiens
  misc_feature: GZ8MTXP01AG8GU.11.81.H04.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccacctgtctgtgtctccaggggaaanagccaccctctcctgcagggccagtcagagtgttagcaacaacttagcctggtaccagcagaacctggaccaggctcccaggctcctcatctatggtncatcccacgagggccactgactccagccaggttcagtcgcaggtggtctgggaacagngttcactctcacatcagcagcctgcagtctagtagtatttgcttagttttactgtctagggtctagttatacgttaactcgggtcctaccgttaacgtcgttttcgggacccgtacgggggtaaccctaaggcttaaacggaaattaccgaaaacgtacgttaggttgactaagtaccaactattcttgtcttctaacc

SEQ ID NO: 337456 - DNA, 561 bp, Homo sapiens
  misc_feature: GZ8MTXP01ASWN5.11.81.H04.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccacctntcctgcagggccagtcagagtgtagcaacacttagcctggtaccagcagaactggccaggctcccaggctcctcatctagtggtncatcccaaccgaggggcccaacgtgggtaactccccgagccctaggtttccaggtcggctaggtggggtctggggaacagaagttcaactctacacctatcagcagcctgcagtctagaagtatttgacttagttttactgtacaggtctagttatagtacgtcggtcctacgtactacgtttcggacgtacgggaccaagcttaagtaaattacgaaacgtaacttaggttcggctcgacgtaactactacgttacgttcttcgtaac

SEQ ID NO: 337457 - DNA, 547 bp, Homo sapiens
  misc_feature: GZ8MTXP01ESE00.11.81.H04.1.454.CMB.2.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagcctggtaccagcagaaacctggccaggctcccaggctctcatctatggtncatccaccagggccactggtactcccagccaggttcagtcggcagtgggtctggggaacagngttcactctcaccatcagcagcctgcagtctagtaagttatttgcttagtttttactgtcaggctagtatagtaactggtcctcgtatacgtttggccgtaggggaccaagtccttaaaggtaaacttccgaaaacgtaacgttggttcgggacttcgacaaccattccttcgttcctttcgtaaccg

SEQ ID NO: 337458 - DNA, 557 bp, Homo sapiens
  misc_feature: GZ8MTXP01ELGIV.11.81.H04.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (395)..(395): a, c, t, g, unknown or other
  misc_feature (395)..(395): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaangcccacctctcctggcagggccagtcagagtgtagcaaacaacttgcctggtaccagcaagaacctggccaggcctccagctcnatctatgtncatccacgaggccagtggtacncccagccaggttcaggtcgcaggtcgggtctggggaacagtgttctactctcaccatcagcagcctgcagtctagtaagtntttgactttagttttactgtcagtctagttatacgtacgtcggtccttccgttacttcgtttcgggaccgtaacggggaccgtaaagtacttaaacggtaaattacgtaaacgtaacttggttcggttcgtcgccaacctacttcgttcgttcttcttaacc

SEQ ID NO: 337459 - DNA, 571 bp, Homo sapiens
  misc_feature: GZ8MTXP01DIRSZ.11.81.H04.1.454.CMB.2.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacaacttagcctaggtaccagcaagaaacctggccaggcctccgaggctcctcatctatggtncatcccaccgagggcccacgtggtactcccgagccctaggttcaggtcggctaggtgggtctggggaacagtcgttcactctacaccatcagcagcctgcagttctagtaagttattttgtacttagttttactgttacaggtactagttaatacgtaacgtcgtccttacgtacttacgtttcggaccgaggggtaaccaagtacttaaagaaacttacgaaacgtacgttggcggttactgacctaactatcgttacgttcttctaacc

SEQ ID NO: 337460 - DNA, 541 bp, Homo sapiens
  misc_feature: GZ8MTXP01DKD8W.11.81.H04.1.454.CMB.2.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagcctggtaccagcagaacctggcaggctcccaggctctcatctatggtncatccacagggccactggtacncccagccaggttcaggtcgcagtgggtctgggaacagngttcactcncaccatcagcagcctgcagtctagaagtatttgcttagtttttactgttcagggtctaagttatagttaactcggtccttccgtactacgttttggaccgtacggggaaccaaagaccttaaggaaacttacgaaaacgtacttggttcgctgactaacctatcttcgtcttctaacc

SEQ ID NO: 337461 - DNA, 565 bp, Homo sapiens
  misc_feature: GZ8MTXP01DFRAX.11.81.H04.1.454.CMB.2.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccacctntcctgcagggccagtcagagtgtancaacaacttgcctggaccagcagaactggcaggctccaggctcnatctatggtncatccacagggccatggtacncccagccaggttcagtcggcagtgggtctgggaacagtnttcactctcaccatcagcagctgctagtctagtaagttntttgtacttagtttttactgttcgagtctaagtatacgtaactcggtccttaccggttacttcgttttaggacccgtaacggggaaccctaaagtacgttaaaggtaaacttaccgaaaacggtaacgttcggttacggttcttcgacctaacccttattcttcgtttccttcgttaacccg

SEQ ID NO: 337462 - DNA, 569 bp, Homo sapiens
  misc_feature: GZ8MTXP01B6UY8.11.81.H04.1.454.CMB.2.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaanagccaccctntcctgcagggccagtcagagtgttagcaanaacttagcctggtaccagcaagaacctggccaggctcccaggcctcctnatctanggtncatccacagggccatggacnccagccaggttcagtcggcaggtggtctgggaacagtgttcactctcaccatcancagcctgcagtctagaagtatttgacttagttttactgtacaggtctagttatagtaactcggtccttcgtacgttacgtttggaccgtaacggggacctaaggacgttaacggtaaacttaccgtaaaacgtaacgttggttacggaccgttaacgacctaacctaacttccgttacttcccgtttcttaacccg

SEQ ID NO: 337463 - DNA, 609 bp, Homo sapiens
  misc_feature: GZ8MTXP01BERXE.11.81.H04.1.454.CMB.2.raw
  modified_base (201)..(201): a, c, t, g, unknown or other
  misc_feature (201)..(201): n is a, c, g, or t
  modified_base (318)..(318): a, c, t, g, unknown or other
  misc_feature (318)..(318): n is a, c, g, or t
  modified_base (399)..(399): a, c, t, g, unknown or other
  misc_feature (399)..(399): n is a, c, g, or t
  modified_base (453)..(453): a, c, t, g, unknown or other
  misc_feature (453)..(453): n is a, c, g, or t
  modified_base (588)..(588): a, c, t, g, unknown or other
  misc_feature (588)..(588): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggaagaaatagtgatgacgcagtctccagccaccctgtctgtgtctccgaaggggaaancgcccaccctctcctgcagggccagtcagagtgttagacaaactaacttagcctagggtaaccaggccaaggaaaccctggaccaacggcctccccgaggctcctcatctagtggtncatcccacgagggcctaacgtcggtactcccgagtcccaggttcaggtcggcgaggtgggtcgtaggaacagtgtcactcncacatcagcacgcctgctagtactaggtagtttattttgacgtttagttttacngtacaggtactaaggttactaacggtaacgtggtcccttacggttaactttacgtttgggaccgtacgggggtaaccaaagtacgttaaagaaacgttacgaaaacggtacgttggttcggactaacgctaactntacttgtaacctttcgtaacc

SEQ ID NO: 337464 - DNA, 502 bp, Homo sapiens
  misc_feature: GZ8MTXP01ATPAL.11.81.H04.1.454.CMB.2.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (485)..(485): a, c, t, g, unknown or other
  misc_feature (485)..(485): n is a, c, g, or t
tcagcgagagataccacgaccggtgctcgatttagtagtgtagattcgcggggaggaactgctcagttaggacccagacggaccatggaagccccagcgcagcttctcttcctcctgctactctggctcccagataccactggagaaatagtgatgacgcagtctccagccaccctgtctgtgtctccaggggaaagagcccaccctctcctgcagggccagtcagagtgttagcaaacaacttagcctggtaccagcagaactggcaggctccaggctcncatctatggtncatcccaccagggccatggtatccccagccaggttcagtcgcagtgggctggggaacagngttcactctcaccatcagcagcctgcagtctagatatttgcttagtttttacngtcaggtctagtatagtaactgcctcgactcttggcagggcaagcttaagaacttcgaaacgtcttgttggctgccaacngtccttgttcttctaac

SEQ ID NO: 337465 - DNA, 554 bp, Homo sapiens
  misc_feature: GZ8MTXP01ATOCQ.11.81.H04.1.454.CMB.2.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
  modified_base (539)..(539): a, c, t, g, unknown or other
  misc_feature (539)..(539): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgttagcaacaacttagcctggaccagcagaacctggccaggctccaggctcctcatctatggtncatcccacagggccagtggtactcccagccagggtttcaggtcggctaggtcggggtcgtaggggaacaggtcgttcacgtctaccaccatcaagcagcctgcagtctagaagtnttttgctttagttttactgtcagggtctaagtatacgtaacgtggtcccttaccgtacttcgtttcggaccgtacggggaccaagtacgttaagaaacttacgaaacgtacttggttcgctgctaactntcttgtcttctaacc

SEQ ID NO: 337466 - DNA, 589 bp, Homo sapiens
  misc_feature: GZ8MTXP01BZ3L0.11.81.H04.1.454.CMB.2.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccgaaggggaaancgcccaccctctcctgcgagggccagtcagagtgtagcaactaacttgcctggtaccagcaagaacctggccaggctcccaggcctctcatctatggtncatcccacgagggcctagtggtactccagcctaggtcagtcgctaggtgggtctgggaacagtgtcactctacacatcagcacgcctagcagtctagtaagttatttgtacttagttttactagttcagggtactaaggttaattacggttaacgtcggtacccttaccgttaacgttcgtttacgggaccgtaagggggtaaccctaaaggtacgttaaaggtaaacttacgaaaacgtacgttggttcggactcgacctaaccgtatccgttcgttaaccttcgtaacc

SEQ ID NO: 337467 - DNA, 576 bp, Homo sapiens
  misc_feature: GZ8MTXP01E00ZW.11.81.H04.1.454.CMB.2.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (458)..(458): a, c, t, g, unknown or other
  misc_feature (458)..(458): n is a, c, g, or t
  modified_base (522)..(522): a, c, t, g, unknown or other
  misc_feature (522)..(522): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagcccaccctgtctgtgtctccgagggaaangccaccctncctgcagggccagtcagagttgttagcaacacttagcctggtaccagcagaaacctggccaggctcccaggcctcctcatctatggtgcactcccaccgacggggcccacgtggtactccccgagcctagggtttccaggttccggccgtagggtcggggtccgtggggaaccaggtaacgtttccaacctcctccaccatccaagcacgcctggcagttctagaacgttattttgcttagttttttacngttcaggtctagtatacgtacgtcggccctcgtactcgtttggcgacggggtacaagacttaanaaacttacgaaacgtaacttgttcgctgccaacctatcttcgtccttcgtaacc

SEQ ID NO: 337468 - DNA, 755 bp, Homo sapiens
  misc_feature: GZ8MTXP01CW0B0.11.81.H04.1.454.CMB.2.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggcctcccagataccactggagaaatagtgatgacgcagtctccagcccaccctgtctgtgtctccgaggggaangcccaccctctccngcagggccagtcagagtgtagcaactactagcctggtaccagcaagaactggcaggctccagctcctnatctatggtncatcccacgngggcctagtcggtactccccgagcccgtaggttccaggtcggccgtaggtgggtcgtagggggaaccaggtaacgttccaaaccgttcctaccaacccgtattcccgagtacccacgtaccccgttcggaccgtaacggttaccgttaaggtaaagtttacgtttttacggtaccgttttaacggtttttttaacgtacggttacgtaacggggtacgttaaggtttaaacgttaaacggtttaaccggttaccggggttacccctttacccggtttaaccgtttaccggtttttaccgggggacccggtaaccgggggtaaacccctaaacgggttaacgttaaaacggtaaaaccgttaaaccggtaaaaccggtaaccgttacgggttcggttaccgttaacggaccctaaccgtacgttaccgtttacgttcccgttttcgtaacccg

SEQ ID NO: 337469 - DNA, 631 bp, Homo sapiens
  misc_feature: GZ8MTXP01C6EE7.11.81.H04.1.454.CMB.2.raw
  modified_base (201)..(201): a, c, t, g, unknown or other
  misc_feature (201)..(201): n is a, c, g, or t
  modified_base (433)..(433): a, c, t, g, unknown or other
  misc_feature (433)..(433): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcaacaacttagcctggtaccagcagaacctggccaggctccaggctcctcatctatggtgaccatccccgacccgagggggccccaacgttcgggtaactccccgagccccgtagggtttcaggtcggccagggttgggtctgggggaacaggcgttcacctctaccaccatcagcagcctggctagtctgtaagtnttttgacttagtttttactgtctaggtctagttaattagttaactcgggtcccttaccgttacgtacgttttcgggaccgtaagggggacccaaaggtacgttaaagaaacgttacgtaaaaccggtaacttacgggttcggttaccgttggtaacccaaccgtaacgttccttacggtttcctttaaccgtttcccg

SEQ ID NO: 337470 - DNA, 746 bp, Homo sapiens
  misc_feature: GZ8MTXP01C22CK.11.81.H04.1.454.CMB.2.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggcctcccagataccactggagaaatagtgatgacgcagtctccagcccaccctgtctgtgtctccgaggggaaangcccacctctcctgcagggccagtcagagtgttagcaactaacttagcctggtaccagcaagaacctggccaggctcccgaggctcctcatctatggtncatcccacgagggccacgtgtactcccagcccaggttcagtcggccgtaggtcgggtctaggggaaccaggtcgttccaaccgttcctaccaaccatccgaacgccgacgtccgttgctacgttacgttagtaaacgtttattttacgtactttagttttttacgtagttccgtaagggttacgttaaggtttaacgttaacggtttaaaccgttccgggttaccccgtttacccggtttaacccgtttaaccggtttttaccgggggaaccccggtaaacggggggtaacccctaaaacgggttaaccgttaaaacggtaaaaaccgttaaaccgtaaaaacccgggttaaacggttaccgggttcgggttacccgtaacgggtacccgtaacccttaacgttaccgtttccggttttaacccctttaaccggttttaaccccg

SEQ ID NO: 337471 - DNA, 643 bp, Homo sapiens
  misc_feature: GZ8MTXP01ADQDH.11.81.H04.1.454.CMB.2.raw
  modified_base (200)..(200): a, c, t, g, unknown or other
  misc_feature (200)..(200): n is a, c, g, or t
  modified_base (302)..(302): a, c, t, g, unknown or other
  misc_feature (302)..(302): n is a, c, g, or t
  modified_base (410)..(410): a, c, t, g, unknown or other
  misc_feature (410)..(410): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcagggccagtcagagtgtagcaaactaacttagcctggtaccagcaagaaacctggccaggcctcccaggcctcctcatctatggtncatcccacgacggccagtgtactccgagtccaggttcagtcggctaggtgggtcgtgggaacagtcgttcaccgtctaccacctatcacgacacgcctaggctagttntaagtaagttagttttgtaccgtttagtttttaactcgttacagttacgtaagttaacgttaacggttaaccgtggtaccccgttacgttaacgttaccggttttcggaaccgacgggggtaaaccctaaagtaacccgttaaagtaaacgttaaacgtaaaaccgtaagttacggttcggttactaacggacctaacgtaactcgttaacgttaactttaaccgtaaccccg

SEQ ID NO: 337472 - DNA, 560 bp, Homo sapiens
  misc_feature: GZ8MTXP01BAL3O.11.81.H04.1.454.CMB.2.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccgaaggggaaangcccaccctntcctgcagggccagtcagagtgtagcaacacttgcctggtaccagcagaacctggccaggctccaggcctcctcatctatggtgcatcccaccgagggccacgtcggtactcccgagcctaggttcaggtcggcgtaggtgggtctggggaacaggtgttcactctcacatcagcacgcctgcagtcgtagtaagttattttgtacttagtttttactgttacaggtctagttatacgtaactcggtcctaccgtactacgtttcggaccgtacggggaccaagtacgttaaagtaaagttacgaaacgtattcggttggctaacgcaactactcgttcgtcttcgtaacc

SEQ ID NO: 337473 - DNA, 673 bp, Homo sapiens
  misc_feature: GZ8MTXP01AO6E5.11.81.H04.1.454.CMB.2.raw
  modified_base (199)..(199): a, c, t, g, unknown or other
  misc_feature (199)..(199): n is a, c, g, or t
  modified_base (372)..(372): a, c, t, g, unknown or other
  misc_feature (372)..(372): n is a, c, g, or t
  modified_base (414)..(414): a, c, t, g, unknown or other
  misc_feature (414)..(414): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacacagtctccggccaccctgtctgcgtctcctggggaaacngtcaccctctcctgcagggccagtacaaaattattaaacaactacttagcctggttccaacagaaacctggccaggctcccaggctctcatctatgatgcatttaggaggccactggcactcccaccaggttcagtgctaggtcgggtctggggacagtacttcaactttccncaccatcccgcaacgtccctaagacgcccgtagaaacggttntttttaggaccttaaggtttttaacttacttacggtaactaaacgagtacggttacgacgagggccgaacgggtccccgtaccggggacgtaccgggttaccggaccggtaaacgggggaacccgtaaaggggtacggaaacggtcggaaacggaccggttaaaccgtttgggcggtaccgttcgggaccgaccccgttaatttcccgtaacggttcccttttaccgtaccgtttacccctttccccggcctttaaccg

SEQ ID NO: 337474 - DNA, 623 bp, Homo sapiens
  misc_feature: GZ8MTXP01BJL4L.11.81.H04.1.454.CMB.2.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaaactaacttagcctaggtaccagcagaaacctggccaggctcccaggctcctcatctatggtncatcccacgagggccatggtactcccgagcctaggttcaggtcggacgtagggtcggggtcnggggaaacaggngttccactcctaccacatcacgacacgcctgctagtctagtaagttnttttcgactttagtttttactgttacaggtactaggttatacgtaacgtcggtccttcgttactcgttttcgggaccgtacgggggtaacctaaaggtaccttaaaggtaaacttaaccgtaaaacggtaacgttacgggttcggttaccgttaacgaccgtaaccctaacgttccttacgttaaccgtttccgtaacccg

SEQ ID NO: 337475 - DNA, 566 bp, Homo sapiens
  misc_feature: GZ8MTXP01EXP4Y.11.81.H04.1.454.CMB.2.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagcctggtaccagcagaaacctggccaggctcccaggctcctcatctatggtncatccacagggccactggtactcccagcctaggttcaggtcggcaggtgggtctggggaacagtcgttcactctcaccatcagcagcctgcagtctagtaagtattttgacttagtttttactgtactaggtcgtaagttatagttaactcggtccttaccgtacttacgtttcggacccgtaacgggggaacctaaggtacttaaggaaacttacgaaacgtaacttggttcggctcgcaacctacttcgttacgttccttcgtaacc

SEQ ID NO: 337476 - DNA, 532 bp, Homo sapiens
  misc_feature: GZ8MTXP01ADAT5.11.81.H04.1.454.CMB.2.raw
  modified_base (199)..(199): a, c, t, g, unknown or other
  misc_feature (199)..(199): n is a, c, g, or t
  modified_base (348)..(348): a, c, t, g, unknown or other
  misc_feature (348)..(348): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacacttagcctggtaccagcagaactggccaggctcccagctcctcatctatggtgcatcccacgagggccatggtactcccagccaggttcagtgcagtggctgggaacagngttcactctcacatcagcagcctgcagtctgagtatttgcttagttttactgtacagctagtatagtaactgtcctccgtaactcgttttggaccgaggggtacccaagtaccgttaagaaaacgttcgaaaacgtaccgttgttacggcgtcgacctaacctagtcttcgtcctttccgtaac

SEQ ID NO: 337477 - DNA, 602 bp, Homo sapiens
  misc_feature: GZ8MTXP01A3H52.11.81.H04.1.454.CMB.2.raw
  modified_base (200)..(200): a, c, t, g, unknown or other
  misc_feature (200)..(200): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcaacaacttgcctggaccagctagaacctggaccaggctcccgaggcctcctcatctatggtgcactcccgaccgagggcccacgtcgggtactcccgagccgtaggttcaggtggcaggtgggtctgggaacaggngtttcacctctacacatcagcncgctcgcgtagtacgtagtagttagtttgttacgtttacgtttacgttagtacgtaggtacgtagttaacgttacgttacgtcgtccgttaccgttacgttacgttcggtacggtacgggtaacgtaacgtaacgttaaagtaaacgttaacgtaaacgtaacgttacggttcgttcgtcgtactaactactcgttcgttcttcgtccg

SEQ ID NO: 337478 - DNA, 640 bp, Homo sapiens
  misc_feature: GZ8MTXP01ANDPC.11.81.H04.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (276)..(277): a, c, t, g, unknown or other
  misc_feature (276)..(277): n is a, c, g, or t
  modified_base (285)..(285): a, c, t, g, unknown or other
  misc_feature (285)..(285): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacccagtctccagccacctgtctgtgtctcgaggggaancgccaccctntcctgcagggccagtcagagtgtagcaanacttagcctggaccagcagaactggcaggctccagctctnntctatgtncatccaccagggccacgtggtactcccgagcctaggttcaggtggcctaggtgggtatgggacaaagtgttcactctcactagtcagcacgcctggactagtccgtagtaaagttacgtttttcgtacgtttacgtttttacgtgttactaggtactagttaagttacgtaaaccgttcggtcccttcgttacgttaaccgttttcggaccggttaaacgggggaccctaaaggtaaccgtaaacgttaaaacgttaacccgaaaacggttaaaccgtagggttccgggttaccttaccggaaccgaaccccgttaattcccggttcgtttacgttcccttaacgttttcccccg

SEQ ID NO: 337479 - DNA, 567 bp, Homo sapiens
  misc_feature: GZ8MTXP01ADM8F.11.81.H04.1.454.CMB.2.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (431)..(431): a, c, t, g, unknown or other
  misc_feature (431)..(431): n is a, c, g, or t
tcagcgagagataccacgaccggtgctcgatttagtagtgtagattcgcggggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaangcccaccctctcctgcagggccagtcagagtgttagcaaactaacttagcctggtaccagcaagaaacctggccaggctcccgtggcctcctcatctagtggtncatcccacgaggggcccagtcggtactcccagccaggttcaggtcggcaggtgggtatgggaacagtcgttcactctcacatcagcagctgctagtctagtagttagtttgtacttgttttacngtcaggtctagtataagttacgtcggtccttaccgttacgtcgttttcggaccgtaaggggaacctaaggacttaaaggaaacttacgaaacgtacttggttgttactcgactaacctattcttcgttcttcgtcc

SEQ ID NO: 337480 - DNA, 514 bp, Homo sapiens
  misc_feature: GZ8MTXP01BGQVJ.11.81.H04.1.454.CMB.2.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcaacaacttagcctggtaccagcagaacctggccaggctcccaggctcctcatctatggtncatcccaccagggccacgtggtactcccagccaggttcagtcggctaggtgggtctggggaacagtgttcactctcaccatcagcagcctgcagtctagaagtntttgcttagtttttactgtcaggtctagtatagtaactggccttcgtactctttcggccgtagggaccaagcttagaaacttcgaaacgacttgngctgcaacntcttcgtcttctc

SEQ ID NO: 337481 - DNA, 560 bp, Homo sapiens
  misc_feature: GZ8MTXP01D7MGS.11.81.H04.1.454.CMB.2.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaanacgcccaccctctcctgcagggccagtcagagtgttagacaaacaacttagcctggaccagcagaaacctggccaggcctacccgaggtcctacctacatctatggtncactcccacgacgggccagtcggtactcccgagtccaggttcaggtcggctaggtgggtctgggaacagngttcactcncacntcagcncgctgcagtctagaagttatttgtcttagttttactgtacaggtctagtagtagtacgtcgtccttcgtactacgttggaccgtacggggaacaagtacttaaagtaaacttacgaaacgtacgttggttcgctgtccaactcgtacttcgtccttcgtccg

SEQ ID NO: 337482 - DNA, 632 bp, Homo sapiens
  misc_feature: GZ8MTXP01BPIWW.11.81.H04.1.454.CMB.2.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
  modified_base (407)..(407): a, c, t, g, unknown or other
  misc_feature (407)..(407): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcaacaacttagcctaggtaccagcaagaaacctggaccaggcctcccgaggcctcctcatctagtggtcnctactcccacgacgggcctacgtcggtactcccgagtccgtaggttcaggtcggcgtaggtgggtctggggaaaccagtcgttcaaccttctaccacctancgacgcacgcctgcgtagtcgtagtaacgttagtttcgtactttagttttactgttacgaggtacgtaagttacgtaacgttaaccgtcggtacccgttaccgttaacgttcgtttaccgggaccgtaacggggaacctaaacggtacgttaaacgtaaacttaccgaaaacgtacgttggttcggttactcgactaacgtacgtcttacgttccttctaacccg

SEQ ID NO: 337483 - DNA, 793 bp, Homo sapiens
  misc_feature: GZ8MTXP01AK7U0.11.81.H04.1.454.CMB.2.raw
  modified_base (200)..(200): a, c, t, g, unknown or other
  misc_feature (200)..(200): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgtagcaaacacttgcctggtaccagcaagaacctggaccaggcctacccgaggcctcctacatctagtggtcgacctactaccccaccgacgggggacccctacgttacgggtacctcccccgaggtccccgtaaggggtttcaaggttccgggacgtagggttcgggggtactgggggaaacctaagggtcgtttaccacccttctacccaacctactaccgaaacggccgaacggtcccttacggacgtaacgttaccgttaagtaaacggtttagtttttacgtaacgttttaacggtttttttacgtacggtttaccgaaggggtacgttaagggtttaaactttaaaccgggttaaaccgttcccggggttacccctttacccggttaaccgtttaaccggttttcggggaacccggttaaccgggggaaaccccgtaaaggtaacgttaaacggtaaaaccttaaccgaaaaccgggtaacgttcgggttcggttaccggttaacgacccgtaacccgttactacccgtttacggttaaccctttcgttaaccccg

SEQ ID NO: 337484 - DNA, 648 bp, Homo sapiens
  misc_feature: GZ8MTXP01B6BLS.11.81.H04.1.454.CMB.2.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
  modified_base (367)..(367): a, c, t, g, unknown or other
  misc_feature (367)..(367): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaaactacttagcctggtaccagcagaaacctggccaggcctcccaggcctccncatctagtggtcgcactccccgaacgagggcccagtcggtactccccgagccctaggttcaggtcgcgtaggtgggtcnggggaacaggtcgttcacttcctacgaccctatcgacgcacgcctgctagttctaggtaagttatttcgtctttagtttttactcgttacgaggtacgttaggttacttaacggttaactccggtcccttaccggttaccgtttaccggttttacgggacccggtaaacgggggaacctaacggtaacgttaaaggtaaacttaacgtaaaaccgtacgttaggttcggttacgtaacggtactaaccgtacgttacgttcgtttccttaacgttaacccg

SEQ ID NO: 337485 - DNA, 535 bp, Homo sapiens
  misc_feature: GZ8MTXP01BPZB6.11.81.H04.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (378)..(378): a, c, t, g, unknown or other
  misc_feature (378)..(378): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggcctcccagataccactggagaaatagtgatgacgcagtctccagccaccctgtctgtgtctccgaaggggaaancgcccaccctctcctgcagggccagtcagagttgtancaaactaacttgcctggtaccagcagaactgcagcnccagctcncatctatgtncatccacgaggcctatgtactccagcctagtcagtcgcagtggtctgggaacagtgttcactctacacatcagcagcctgacagtntagtaagttagtttgtacttagtttttacgtgtacaggtataagtaatacgtacgtcgtccttaccgtactcgttacggacgaggaactaagtacttaaagtaaacttaacgaaaacgtagttggttcgctaacgacaactatcttctcttcgtaac

SEQ ID NO: 337486 - DNA, 656 bp, Homo sapiens
  misc_feature: GZ8MTXP01CNUSZ.11.81.H04.1.454.CMB.2.raw
  modified_base (201)..(201): a, c, t, g, unknown or other
  misc_feature (201)..(201): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagagtgtagacaacaacttagcctaggtaccagacagaaacctggaccaggcctcccgaggcctcctcatctagtggtcgacactcccgaccgacggggccctacgtcggtaactccccgagtcccgtaaggttcaggtcggcgtagggtcgggtcgtggggaaacctaggtcgttccaacgttcctacaaccctatccgagcacgtcctgctagtcgtagtaacgttatttcgtactttagttttactgtactaggtacgtaagttagttacgttaacgtcggtcccttacggttaacgttacgtttcggaccgtaacggggtaaccgaaagtaacgttaaaggtaaacttaccgtaaaacgtacgttacggttcggttaccgttaacgactaacctcgttacgttccgttaacttccgttaacccg

SEQ ID NO: 337487 - DNA, 583 bp, Homo sapiens
  misc_feature: GZ8MTXP01B6T2R.11.81.H04.1.454.CMB.2.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (555)..(555): a, c, t, g, unknown or other
  misc_feature (555)..(555): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgtagcaacaacttgcctaggtaccaacagaaacctggccaggctccagctctnatcatgtgcatccaccgaggccagtgtactcccagccaggttcagtcggctaggtggtctgggacaagtacgttcactctcacctatcagcagtctgctagtctagtaagtattttgtacttagttttacgtgtactagtactaagttattaacgtaacgtcggtcccttaccgttacgttacgttttcgggaccgtacggggtaacctaaggtaacgtaaagaaacttaaccgaaacgtaacgtggttacggttcgttacgcctaacctnttacgttcgttcttccgttcgttccccg

SEQ ID NO: 337488 - DNA, 840 bp, Homo sapiens
  misc_feature: GZ8MTXP01C8V2Q.11.81.H04.1.454.CMB.2.raw
  modified_base (202)..(202): a, c, t, g, unknown or other
  misc_feature (202)..(202): n is a, c, g, or t
  modified_base (380)..(380): a, c, t, g, unknown or other
  misc_feature (380)..(380): n is a, c, g, or t
tcagcgagagataccacgaccggtgctcgatttagtagtgtagattcgcggggggaggaactgctcagttaggacccagacggaaccatggaagccccagcgcagcttctcttcctcctgctactctggcctccagataccatggagaaatagtgatgacgcagtctccagccaccctgtctgtgtctaccgaaggggaaancgcccaccctctccgtgcgagggccagtcagtagttgtagactaaactaacttagcctaggtaaccagacaacggaaaccgtcggaccacgggccctacccgaggtcccttccctactacttcttagtcggtacgacctactaccccgaccgtacgggcccctaagtcgggtaacccncccgagtccgtaacggtttcgaggtccggcggtagggttcggggtcgtaggggtaaactagggtaacgtttccctaaccttccgtaaccaccgtaagtccgaaacggtcctaacggtccccgtaggtacgtaaccgttacgtaaagggttaaacgttttgtttttacggttacgtttttaacgttttttacgtacggtttaccgtaaggggttaaccgtttaaaaggttaacgtttaaaccgggttaaacccgttccggggttacccctttaccggtttaaaccgtttccgggtttaacccgggggaacccgggtaaaaccgggggtaaaccccttaaagggtaaaccgttaaacggtaaaaaccttaaccggtaaaaaccgggttaccgtttagggacgttaccggttaaccaacctaaccgttacgttccgtttacgttccctttaacgttaaccccg

SEQ ID NO: 337489 - DNA, 595 bp, Homo sapiens
  misc_feature: GZ8MTXP01AFQKB.11.81.H04.1.454.CMB.2.raw
  modified_base (197)..(197): a, c, t, g, unknown or other
  misc_feature (197)..(197): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccgaggggaancgccacctctcctgcagggccagtcagagtgtagcaactacttgcctggaccagcagaacctggccaggctccaggctcctcatctagtggtgacctatccccgacgacggggtcccacgttcgggtactccccgagtacccgtaagggttccagggttcggaccgtagggttcgggtccgtagggggaacctagggtcgttcacgtctacacatcagcagctgctgtctagtagttatttaggacttagttttacgtgttacgaggtacgtaagttacttaagttaactcggtcctacgtacgtcgtttggaccggtagggtaccaagtacgttaagaaacttacgaaacgtacgttggttcgacgtgacctaacgacttacgttcttccttcgtcc

SEQ ID NO: 337490 - DNA, 640 bp, Homo sapiens
  misc_feature: GZ8MTXP01AU83T.11.81.H04.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (391)..(391): a, c, t, g, unknown or other
  misc_feature (391)..(391): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtcctccgaaggggaaancgcccaccctctcctgccgagggccagtcagagtgttagcaaacacttgcctaggaccagcagaaacctggccacggctcccaggctcctnactctagtggtgcatacccacgacgggccacgtggtactcccgagtcccgtaggttccaggtcggacaggtgggtaggggaacagtaagtcacttccnctaacgctcgagtacacgctagctagtctagtagttatttagtcgttaagtttttacgtgttacgtacggtacgtaacgttaagttaacggttaacgtccgtacccgttacccgttaccttaccggttttcgggacccggtaacggggaccctaaaggtcttaaaggtaaacgttaacgtaaaccgtaaccgttggttacggacgttccggactaacccgtacttccgttacttcgttcccgttaaccc

SEQ ID NO: 337491 - DNA, 519 bp, Homo sapiens
  misc_feature: GZ8MTXP02G0NOT.11.81.H04.1.454.CMB.2.raw
  modified_base (198)..(198): a, c, t, g, unknown or other
  misc_feature (198)..(198): n is a, c, g, or t
  modified_base (358)..(358): a, c, t, g, unknown or other
  misc_feature (358)..(358): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggctcctcatctatggtgcatccaccagggccactggtactcccagccaggttcagtcggcagtgggtctggggacaggngttcactctcaccatcagcagccctgcagtctagagtatttgcttagtttttactgttctatctagtattagtaactcggcctcgtactacgtttggaccgtaggggaccaagctaagaaactacaaacgtactgtggctgacacctatctagtactctac

SEQ ID NO: 337492 - DNA, 490 bp, Homo sapiens
  misc_feature: GZ8MTXP02H1DC5.11.81.H04.1.454.CMB.2.raw
  modified_base (353)..(353): a, c, t, g, unknown or other
  misc_feature (353)..(353): n is a, c, g, or t
tcagcgagagataccacgaccggtgctcgatttagtagtgtagattcgcgggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtcggcagtggtctgggacagngttcactctcaccatcagcagcctgcagtctgaagtatttgctagttttactgtcagcagtatagtaactgctcgtacacttttgctaggggcaagctagaaatacaaacgactagtgctgcacactctctctctac

SEQ ID NO: 337493 - DNA, 532 bp, Homo sapiens
  misc_feature: GZ8MTXP02HN5KY.11.81.H04.1.454.CMB.2.raw
  modified_base (199)..(199): a, c, t, g, unknown or other
  misc_feature (199)..(199): n is a, c, g, or t
  modified_base (369)..(369): a, c, t, g, unknown or other
  misc_feature (369)..(369): n is a, c, g, or t
  modified_base (430)..(430): a, c, t, g, unknown or other
  misc_feature (430)..(430): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacacagtctccggccaccctgtctgcgtctcctggggaaacngtcaccctctcctgcagggccagtacaaaatattaacaactacttagcctggttccaacagaaacctggccaggctcccaggcctcctcatctatgatgcatttagggaggccactggcactccccacctaggttcagtggcaggtggtcctgggacagacttcatttcncaccatccgcagcctagacgcctagaagtatttgctagttttattactgtacacagcgtancagcagcctcggcgtacgtcggacgaagggacgaaggtaggaatcgaaaagcgaaagtcggtacggctcgacacatcgtgtcttcacttccctccgtactac

SEQ ID NO: 337494 - DNA, 515 bp, Homo sapiens
  misc_feature: GZ8MTXP02HG71N.11.81.H04.1.454.CMB.2.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacacttagcctggtaccagcagaacctggccaggctcccaggctcctnatctatggtncatccacaggccactggtatcccagccaggttcagtcggcaggtgggtctgggacagngttcactcncaccatcagcagcctgcagtctagtaagtatttgtacttagtttttactgtcagctagtatagtaactcggtcctcgtactacgtttcggccgtagggaccaagtactagaaactacaaacgtactagtcgctaagcaccatctcgtcttctac

SEQ ID NO: 337495 - DNA, 532 bp, Homo sapiens
  misc_feature: GZ8MTXP02G85O5.11.81.H04.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (410)..(410): a, c, t, g, unknown or other
  misc_feature (410)..(410): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcaacacttagcctggtaccagcagaacctggccaggctcccaggctcctnatctatggtncatcccacagggccatggtatcccagccaggttcaggtcgcaggtgggtctgggacngngttcactctcaccatccagcagcatgcagtctagaagtattttgacttagtttttacngttctagctagtatagtaactggtcctcgtactacgtttcggaccgacggggtaccaagcttaaagaaactacgtaaaacgtaactggtacggctacggacctacctatcctacgtctttac

SEQ ID NO: 337496 - DNA, 507 bp, Homo sapiens
  misc_feature: GZ8MTXP02I4NIG.11.81.H04.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggctcctcatctatggtncatccaccagggccactggtatcccagccaggttcagtggcagtggtctgggacagngttcactctcaccatcagcagccctgcagtctagaagtatttgctagtttttctgtctagctagtatagtaactggacctccgtactactttggcgagggaccaagctagaaactacaaacgactagtgactgcgactactctacgtcttctac

SEQ ID NO: 337497 - DNA, 543 bp, Homo sapiens
  misc_feature: GZ8MTXP02JBFDR.11.81.H04.1.454.CMB.2.raw
  modified_base (198)..(198): a, c, t, g, unknown or other
  misc_feature (198)..(198): n is a, c, g, or t
  modified_base (354)..(354): a, c, t, g, unknown or other
  misc_feature (354)..(354): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagcctggtaccagcagaaacctggccaggctcccaggctcctcatctatggtgcatccaccagggccacgtggtactcccagccaggttcagtcggcagtggtctgggacagngttcactctcaccatcagcagcctgcagtctagtaagtattttgtcgttagtttttactgttactagtactagtattacgtaacgtcggtcccttacgtacttacgtttcggaccgtagggtaccaacgtacgtaagaaacgtacaaacgtactcggtacggactcgacactactcttcgtcttactac

SEQ ID NO: 337498 - DNA, 521 bp, Homo sapiens
  misc_feature: GZ8MTXP02GRBBW.11.81.H04.1.454.CMB.2.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctntcctgcagggccagtcagagtgttagcaacaacttagcctggtaccagcagaaacctggccaggctcccaggctcctcatctatggtncatccaccagggccactggtactcccagccaggtcagtcggcagtgggtctggggacagngttcactctcaccatcagcagcctgcagtctgaagtatttgctagttttactgtcagtctagtatagtaactggacctcgtactacgtttggcctaggggacccaaggcctaagtaaactacgaaaacgactagtacggactggacaccactctacttcttctac

SEQ ID NO: 337499 - DNA, 526 bp, Homo sapiens
  misc_feature: GZ8MTXP02F10UO.11.81.H04.1.454.CMB.2.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
tcagcgagagataccacgaccggtgctcgatttagtagtgtagattcgcgggggaggaactgctcagttaggacccagacggaaccatggaagccccagcacagcttctcttcctcctgctactctggctccagataccactggagaaatagtgatgacgcagtctccagccacctgtctgtgtctccgaggggaaancgccacctctcctgcagggccagtcagagtgttagcaacaacttgcctggtaccagcagaaacctggccaggcctcccagctcncatcatgtncatccacgaggccatgtactcccgagccaggttcaggtcggctaggtgggtctgggacagtcgttcactctcaccatccagcagcctgcagtctagagtatttgtcttagtttctgtcagctagtatagtaactcgtcctacgtactacgtttgaccgtagggactaacgacgtaaagaaactaacgaaacgtacgtaggtcgtactaagaccaactactctacgtcttactacc

SEQ ID NO: 337500 - DNA, 666 bp, Homo sapiens
  misc_feature: GZ8MTXP02JQQU5.11.81.H04.1.454.CMB.2.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagcctggtaccagcagaacctggccaggctccaggctcctcatctagtgcnctacnccacgacggcctagtcgtaccnccgacgacgtacggtcaggtcggacgtgggtcggtcggtaggacaggtcgttaccacttccaccactactacgacgaccgacgtccgtacgacgtacgttcgtaaaggtagtttagttttacgtacgtttttaacgttttacgtacgttacgtacgtaacgttaagtttaacgttaacggttaaccgtcggttacccctttaccgttaacgtttacgggtttaccggaaccgggtaaacgggaaacctaacggtaacgttaaaacgaaacgttaaaaccgaaaacgtaacgttcggtacgtacgtcgaaccctaactacttcgttacgtttacctactttcccg

SEQ ID NO: 337501 - DNA, 527 bp, Homo sapiens
  misc_feature: GZ8MTXP02I1RN3.11.81.H04.1.454.CMB.2.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
  modified_base (360)..(360): a, c, t, g, unknown or other
  misc_feature (360)..(360): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagcctggtaccagcagaacctggccagctcccaggctcctnatctatggtgcatcccaccgaggggcccagtgggtactccccgagcctaggttcagtcggcaggtggtctgggacagngttcacgtctcaccatcagcagcctgcagtctgaagtattttgcttagttttactgtctagtctagtatagttaactcgtcctcgtactacgtttggaccgtaggggacctaacgctaagaaactacgaaacgtacgtagtacgctgacacactctcgtcttactac

SEQ ID NO: 337502 - DNA, 492 bp, Homo sapiens
  misc_feature: GZ8MTXP02I0XJB.11.81.H04.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
tcagcgagagataccacgaccggtgctcgatttagtagtgtagattcgcgggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagcaacacttagcctggtaccagcagaaacctggccaggctcccaggcctcctcatctatggtncatccaccagggccnctggtactcccagccaggttcagtggcagtggtatgggacagngttcactctcacatcagcagcctgcagtctagagattttgctagttttctgtcagctagtatagtaactgcctcgtacactttggccagggaccaagctaagaaactcaaacgactcgtgactgcacatctcgtctctac

SEQ ID NO: 337503 - DNA, 505 bp, Homo sapiens
  misc_feature: GZ8MTXP02FXOQ0.11.81.H04.1.454.CMB.2.raw
  modified_base (199)..(199): a, c, t, g, unknown or other
  misc_feature (199)..(199): n is a, c, g, or t
  modified_base (354)..(354): a, c, t, g, unknown or other
  misc_feature (354)..(354): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggctcctcatctatggtgcatccaccagggccactggtatcccagccaggttcagtgcagtgggtctgggacagngttcactctcaccatcagcagcctgcagtctgaagtatttgctagtttttactgtcagcagtatagtaactggcctcgtactactttggaccgtaggggacctaaggctaagaaactacaaacgactgtaggctgcacactctgtctctac

SEQ ID NO: 337504 - DNA, 521 bp, Homo sapiens
  misc_feature: GZ8MTXP02FL82L.11.81.H04.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggctcctcatctatggtncatcccaccgagggcccactggtactccccagccaggttcagtggcaggtgggtctggggacagngttcactctcaccatcagcagcctgcagtctagaagtatttgtcttagtttttactgttcagtctagtatagttaactcgccttcgtactacgtttcggacgaggggaccaagctaagaaactacaaacgacgtagtgactgcactatctcgtcttctac

SEQ ID NO: 337505 - DNA, 513 bp, Homo sapiens
  misc_feature: GZ8MTXP02JBBBR.11.81.H04.1.454.CMB.2.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagcctggtaccagcagaacctgccaggctcccagctcctcatctatggtncatccaccaggccactggtactcccagccaggttcagtcggcagtggctgggacagngttcactctcaccatcagcagcctgcagtctgaagtatttgcttagtttttactgttacagtctagtatagtaatcggccttacgtactactttggccgtaggggacctaaggctaaagaaactacgaaacgactacgtagctgcacctatctgtcttactac

SEQ ID NO: 337506 - DNA, 569 bp, Homo sapiens
  misc_feature: GZ8MTXP02F088Y.11.81.H04.1.454.CMB.2.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaangccaccctctcctgcagggccagtcagagtgttagcaacaacttagcctggtaccagcagaaacctggccaggctccaggctcctcatctatggtncatcccaccgaggggcccacgtggtactcccgagccgtaggttcaggtcggctaggtgggtctaggggacaggtcgttccacgttctaccacctatcagcagcctgcagtctagtagtatttgtacttagtttttactgttcagtctagtattagtaactcggtccttacgtacttacgtttcggaccgtacggggaccaagtacgtaaagaaactaacgaaaacgtacgtcggtacggtactaacgacctactactcgtcgtcttactacc

SEQ ID NO: 337507 - DNA, 559 bp, Homo sapiens
  misc_feature: GZ8MTXP02JOQ6M.11.81.H04.1.454.CMB.2.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagcctggtaccagcagaaacctggccaggctccaggctcctcatctatggtncatccacngggccactggtactcccagccaggttcagtcggcaggtgggtctggggacaggngttcactcctacaccatcgagcagcctgcagtctagtagtattttgacttagtttttactgtctagtctagtatagtaactcggtccttacgtactacgtttcggaccgtaggggtaaccctaaggtacctaaagaaaacgtacgaaaacgtacgtacggtacggctaacggacctaacctacgtctcgttaccttactacc

SEQ ID NO: 337508 - DNA, 552 bp, Homo sapiens
  misc_feature: GZ8MTXP02HQYNH.11.81.H04.1.454.CMB.2.raw
  modified_base (198)..(198): a, c, t, g, unknown or other
  misc_feature (198)..(198): n is a, c, g, or t
  modified_base (427)..(427): a, c, t, g, unknown or other
  misc_feature (427)..(427): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacacagtctccggccacctgtctgcgtctcctggggaaacngtcaccctctcctgcagggccagtacaaaatattaaacaactacttagcctggttccaacagaaacctggccaggctcccaggctcctcatctatgatgctagtttagggaggccacgtggcactccccaccctaggttcagtggcaggtgggtcctgggacagtacttcattctcaccatccgcacgctagactcctagagtatttgcttagtttatactgtacaacngcgtagcagcgagcctacgggcgtacgttcgacgaacgggtacaagggtggaagtcaaggacgtaacgtggtggtactcgaccaacgtatcttacgtccttacgactttccctaccccgactacg

SEQ ID NO: 337509 - DNA, 518 bp, Homo sapiens
  misc_feature: GZ8MTXP02HGLZ5.11.81.H04.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctntcctgcagggccagtcagagtgttagcaacacttagcctggtaccagcagaacctggccaggctccaggctcctcatctatggtncatccaccagggccactggtactcccagccaggttcagtcggcaggtgggtctgggacagngttcactctcaccatcagcagcctgcagtctgtaagtntttgcttagttttactgtacagtctagtatagtaactcggtcctccgtactactttggaccgtaggggaccaagcgtaagaaactacaaacgactagtaggctgacacctagtctagtccttactac

SEQ ID NO: 337510 - DNA, 550 bp, Homo sapiens
  misc_feature: GZ8MTXP02F9PLQ.11.81.H04.1.454.CMB.2.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagcctggtaccagcagaaacctggccaggctcccaggcctcctcatctatggtncatcccaccgagggcccacgtgggtactcccgagcctagggttcaggtcggcaggtgggtctggggacaggtcgttcactctacaccatcagcacgcctgcagtctagtaagtatttgtcttagtttttactgttctagtctagttatagttaacgtcggtcccttacgtactacgtttcggaccgtacggggacaacgtactaagaaactaacaaacgtacgtagtcggctgcactatcgtactctactac

SEQ ID NO: 337511 - DNA, 581 bp, Homo sapiens
  misc_feature: GZ8MTXP02HWMES.11.81.H04.1.454.CMB.2.raw
  modified_base (200)..(200): a, c, t, g, unknown or other
  misc_feature (200)..(200): n is a, c, g, or t
  modified_base (368)..(368): a, c, t, g, unknown or other
  misc_feature (368)..(368): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgtagcaacattagcctggtaccagcaagaacctggccaggcctcccgaggcctcctcatctagtggtgcactcccacgacggggcccagtggtactcccagccgaggttcaggtcggcaggtgggtctgggacagngttcactctcaccagtcacgcacgcctgcgagtcgtagtaacgttattttcgactttagtttttacgtgttactagtcgttaagttattaacggtacgtcggtccctacgttactcgtttacggaccgaacggggtaccaacggtactaaaggtaaaactaccgaaaacgtacgtgtacggctaacgaccactacgtcttacgtctttctacc

SEQ ID NO: 337512 - DNA, 603 bp, Homo sapiens
  misc_feature: GZ8MTXP02H8O2R.11.81.H04.1.454.CMB.2.raw
  modified_base (198)..(198): a, c, t, g, unknown or other
  misc_feature (198)..(198): n is a, c, g, or t
  modified_base (398)..(398): a, c, t, g, unknown or other
  misc_feature (398)..(398): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgcccaccctctcctgcagggccagtcagagtgttagcaacaacttagcctggtaccagcaagaacctggcccaggcctcccgaggcctcctcatcctatggtgcatcccaacgagggcccacgtggactcccagcccagggttcaggtcggactaggtcgggtctggggacaggtcgttccactcctacacctagtcancacgcctgctagtctagtaagtattttagtcgtttagtttttacttgttacgtagtacgtaagttattaacgtaacgttcggtacctacgttactacgttttcggaccgtacgggtaaccgtaacgacgttaagaaactaaacgaaacgtaacgtagtacggtactaacgtaccaaccgtacttaccttcgtacctttactaccg

SEQ ID NO: 337513 - DNA, 584 bp, Homo sapiens
  misc_feature: GZ8MTXP02JY7SS.11.81.H04.1.454.CMB.2.raw
  modified_base (199)..(199): a, c, t, g, unknown or other
  misc_feature (199)..(199): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgcccaccctctcctgcagggccagtcagagtgttagcaacacttagcctggtaccagcagaacctggccaggctcccaggctcctcatctatggtgcactccaccgagggccaactggtactcccaagcctaggttcaggtcggctagtggggtactggggacagtcgttcactctcaccatcagcagcctgcagtcagacgtatttcgcttagtttttactggtcagtcgtagtagtacgttaacgtcggtacccttacgtacgttacgtttcggaccgtagggggtaacccaagtacgtaaagtaaacgttacgaaaacggtaaaccgttggtcggtactcggaccgtaacctagttccgtcgtttacctacgtttaacccg

SEQ ID NO: 337514 - DNA, 523 bp, Homo sapiens
  misc_feature: GZ8MTXP02FH9Z0.11.81.H04.1.454.CMB.2.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggcctcctcatctatggtncatcccaccgagggcccactggtactcccagccaggttcagtcggcaggtgggtctggggacagngttcactcncaccatcagcagcctgcagtctagaagtattttgcttagtttttactgtcagtctagttatagtaactcggccttccgtactacgtttggaccgtaggggaaccaagactaagaaactacgaaacgactgtgctgcacactctgtctctac

SEQ ID NO: 337515 - DNA, 559 bp, Homo sapiens
  misc_feature: GZ8MTXP02GCTBP.11.81.H04.1.454.CMB.2.raw
  modified_base (200)..(200): a, c, t, g, unknown or other
  misc_feature (200)..(200): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacaacttagcctggtaccagcagaaacctggccaggctccgaggctcctcatctatggtgcatccaccgagggccacgtggtactcccagcctaggttcaggtcggctaggtgggtctaggggacaggtacgttcacttctccaccatcagcacgcctgctagtctagtaacgttatttgtactttagttttactgttacagtctagtatagtaacgtcgtacctcgtactacgtttggaccgtagggaccaacgtacgtaaagaaactaacgaaacgtacgtacgtacggactcgactactactacgtcttacttactaccg

SEQ ID NO: 337516 - DNA, 559 bp, Homo sapiens
  misc_feature: GZ8MTXP02J0KUA.11.81.H04.1.454.CMB.2.raw
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagacgccacccctctcctgcagggccagtcagagtgttagcaacacttagcctggtaccagcagaacctgcagctccagctcnatctatgncatccacgaggccactggtacncccagccaggtcagtcgcaggtcggtctgggacagtgttcactctcaccatcagcacgcctgctagtctagtagtagttttgtactttagtttttactgtactagtactagtattacgtaacgtcgtccgttaccgtacgtacgtttcggaccgtacggggacctaacggtacgtaagtaaactaaccgaaaacgtaccgtaggtacggtacgtaacgacctaccgtacttctacgttacttactaccg

SEQ ID NO: 337517 - DNA, 518 bp, Homo sapiens
  misc_feature: GZ8MTXP02GFPLR.11.81.H04.1.454.CMB.2.raw
  modified_base (198)..(198): a, c, t, g, unknown or other
  misc_feature (198)..(198): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcaacaacttagcctggtaccagcagaacctggccaggctcccagctccncatctatggtncatccaccagggccacgtggtactcccagccaggttcagtcggcaggtgggtctggggacaggtgttcactctacaccatcagcagcctgcagtctagagtatttgtcttagttttactgtcagtctagtatagtactcgtcctacgtactacgtttcggacgtagggacagactaagaaactacgaaacgactacgtgactgactactactcttcgtcttactac

SEQ ID NO: 337518 - DNA, 522 bp, Homo sapiens
  misc_feature: GZ8MTXP02GPGM2.11.81.H04.1.454.CMB.2.raw
  modified_base (198)..(198): a, c, t, g, unknown or other
  misc_feature (198)..(198): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagcctggtaccagcagaacctgccaggctccaggctccnatctatggtncatccaccagggccactgggtactcccagccaggtcagtcggcngtggtctgggacagngttcactctcaccatcagcagcctgcagtctagaagtatttgcttagtttttactgtcagtctagtatagtaactcggccttacgtactacgttttcggaccgtaacggggacaacggtctaaagaaactacaaacgaactgtacggctgacacgtactctcgtacttctac

SEQ ID NO: 337519 - DNA, 557 bp, Homo sapiens
  misc_feature: GZ8MTXP02JJ781.11.81.H04.1.454.CMB.2.raw
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagcctggtaccagcagaaacctggccaggcctcccaggctcctcatctatggtgcatccaccgagggcccacgtggtactccagcctaggttcagtcggcagtgggtctgggacngtgttcactctcacatcagcacgcctgcagtctagagtatttgtacttagtttttactgtctagactagtatagtaacgtcgtccttacgtactacgtttcggaccgtacggggaacctaacgtacgtaaacggtaaactacgaaaacgtaaacgtgtcggactaacgaccaacctacttactcgttaccttctaccg

SEQ ID NO: 337520 - DNA, 521 bp, Homo sapiens
  misc_feature: GZ8MTXP02ISEJQ.11.81.H04.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctntcctgcagggccaggtcagagtgttagcaacacttagcctggtaccagcagaaacctggccaggctcccaggcctcctcatctatggtgcatcccaccgagggccacgtggtactccccagcccaggttcagtcggcagtgggtctgggacnggngttcactctcaccatcagcagcctgcagtctagagtatttgcttagttttactgtcagctagttatagtaacgtcgtcctcgtactacgtttggccgaggggtaccagtactaagaaactacaaacgacgtagtgctgccacactctacgtcttactac

SEQ ID NO: 337521 - DNA, 499 bp, Homo sapiens
  misc_feature: GZ8MTXP02GHQDE.11.81.H04.1.454.CMB.2.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (370)..(371): a, c, t, g, unknown or other
  misc_feature (370)..(371): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(402): a, c, t, g, unknown or other
  misc_feature (401)..(402): n is a, c, g, or t
tcagcgagagataccacgaccggtgctcgatttagtagtgtagattcgcgggggaggaactgctcagttaggacccagacggaatcatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaaacaacttagcctggtacagcagaaactgcagctccagctcncatctatggtncatccacagggccactggtactcccagccaggttcagtgcagtgggtctgggacngagttcactcncaccatcagcancnnagtctgaagtattntntattttattntnannatatagtaactacgtctcgtactacttcgtacgacggacgaagactaacgaaataacaaaacgaaacgtagtaggcgtacgacacactactcgtctc

SEQ ID NO: 337522 - DNA, 546 bp, Homo sapiens
  misc_feature: GZ8MTXP02JSCWQ.11.81.H04.1.454.CMB.2.raw
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcaacacttagcctggtaccagcagaaacctggccaggctcccaggctcctcatctatggtgcatcccaccgaggggccactgggtactcccgagccaggttcaggtcggctaggtgggtctggggacaggacgttcacttctaccacatcagcagcctgcngtctgaagtntttgtcttagtttttactgtctagtctagtattagtaacgtcgtccttacgtactcgtttcggaccgtagggactaacgtactaagaaactacgaaacgacgtcgtacggactcgactacctactcgtcttctactaccg

SEQ ID NO: 337523 - DNA, 534 bp, Homo sapiens
  misc_feature: GZ8MTXP02FJ3FU.11.81.H04.1.454.CMB.2.raw
  modified_base (199)..(199): a, c, t, g, unknown or other
  misc_feature (199)..(199): n is a, c, g, or t
  modified_base (358)..(358): a, c, t, g, unknown or other
  misc_feature (358)..(358): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacctctcctgcagggccagtcagagtgttagcaacaacttagcctggtaccagcagaaacctggccaggctcccaggctcctcatctatggtgcatccaccagggccactggtatcccagccaggttcagtcggcaggtgggtctggggacaggngttcactctcaccatcagcagcctgcagtctgaagtatttgcttagtttttactgtcagtctagtataagtaacgtcgtacctaccgttactacgtttggaccgtaggggacctaaacgctaaaggaaaactacaaaacgtaacgtagtaggctaagcacacttctcgtcttctac

SEQ ID NO: 337524 - DNA, 563 bp, Homo sapiens
  misc_feature: GZ8MTXP02IUXMQ.11.81.H04.1.454.CMB.2.raw
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacacttagcctggtaccagcagaaacctggccaggctcccaggctcctcatctatggtgcatcccaccgagggcccactggtactcccagccaggttcagtcggcagtggtctgggacagngttcactctccaccatcagcagcctgcagttctagaagttattttgtcttagtttttactgttctagctagtattagtaactcggtccttaccgtactacgtttcggaccgacgggggaacctaacggactaaagaaactacaaaacggtaacgtaggtacggtctaacggacctaacctacttccgtacgttcctttactacc

SEQ ID NO: 337525 - DNA, 681 bp, Homo sapiens
  misc_feature: GZ8MTXP02I499C.11.81.H04.1.454.CMB.2.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacacttagcctggtaccagcagaacctggccaggcctccaggcctcctnatctatggtncatcccaccgagggccacgttcgggtactccccaggccctaggtttcaggtcggacgagggttggggtcgtaggggacctagggtacgtttccaaccgttctaccgaaccctagtccagccacgtcccgtgacgtaggttcgtaggtaacgttagtttttacgtaccgtttaaggttttttacttcggttacgtacgtacgttaggttaacgttaggttaaaccgtcggtacccgttaccggttacgttaccgttttcgggaccggtaacgggggtaacctaaacggtacgttaaagtaaaacgtaaccggtaaaaccggtaacgttacggtacggtaccttaacggacctaccgtacttacgttacgtttacctttacgttaacc

SEQ ID NO: 337526 - DNA, 528 bp, Homo sapiens
  misc_feature: GZ8MTXP02ITE2D.11.81.H04.1.454.CMB.2.raw
  modified_base (198)..(198): a, c, t, g, unknown or other
  misc_feature (198)..(198): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagcctggtaccagcagaacctggccaggctcccaggctcctcatctatggtgcatcccaccagggccactggtactcccagccaggttcagtcggcagtgggtctgggacagngttcactcncaccatcagcagcctgcagtctagagtatttgcttagttttactgtcagtactagtatagtaactcgtcctccgtactacgtttggccgtaggggaccagcgtaagaaactacgaaaacgtacgtagtcggactgaccaacctactcctacgttccttactacc

SEQ ID NO: 337527 - DNA, 514 bp, Homo sapiens
  misc_feature: GZ8MTXP02GEF23.11.81.H04.1.454.CMB.2.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctcccaggctcctnatctatggtncatcccacagggccactggtactcccgagccaggttcagtcggcaggtgggtctgggacagtgttcactctcacctatcagcancctgcagtctagaagtatttgtnttagtttttatgtcagctagtatagtaactcggcctcgtactacgtttgaccgaggggtaccaagctaagaactacaaacgtactacgngctgcactanactgtctctac

SEQ ID NO: 337528 - DNA, 573 bp, Homo sapiens
  misc_feature: GZ8MTXP02GJE55.11.81.H04.1.454.CMB.2.raw
  modified_base (199)..(199): a, c, t, g, unknown or other
  misc_feature (199)..(199): n is a, c, g, or t
  modified_base (414)..(414): a, c, t, g, unknown or other
  misc_feature (414)..(414): n is a, c, g, or t
tcagcgagagataccacgaccggtgctcgatttagtagtgtagattcgcggggaggaactgctcagttaggacccatacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacaacttagcctggtaccagcagaacctggccaggctcccaggctcctcatctatgtgcatccaccgagggccacgtggtactcccgagtccaggttcaggtcggactaggtgggtcgtgggacaggtcgttcacttccgtacacctatcgagcacgcctgctagtctagtaagttntttgtacttagttttactgtacagtctaagtatacgtaacgtcggtcctacgttacgtacgtttcggaccgtaaggggtaacccaagtacgtaaagtaaactaaccgaaaacgtacgtagtacggtctaacgacaacgtctacgtcttacttcttaccg

SEQ ID NO: 337529 - DNA, 542 bp, Homo sapiens
  misc_feature: GZ8MTXP02IRBQZ.11.81.H04.1.454.CMB.2.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacacttagcctggtaccagcagaaacctggccaggctccaggctcctcatctatggtncatcccaccgagggccacgtggtactcccagccaggttcaggtcggcaggtgggtctggggacagtgttcactctcaccatcagcagcctgcagtctagtaacgtatttgtacttagtttttactgtactagactagttatagtaacgtcggtcctacgtactacgtttcggaccgtagggactaacgacgtaagaaactacaaacgtactcgtacgctcgacacgtactactcgttctactaccg

SEQ ID NO: 337530 - DNA, 585 bp, Homo sapiens
  misc_feature: GZ8MTXP02JXYXE.11.81.H04.1.454.CMB.2.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgcccacccctctcctgcagggccagtcaggtagtgttagcaaactaacttagcctggtaccagcaagaacctggccaggcctcccgaggcctcctcatctagtggtnctactcccaccgacggggccacgtgggtacctcccgagccgtaggttcaggtcggcagggtgggtcaggggacaggtcgttcactcacactataccagcacgcctgcagtctagtaagtnttttcgtactttagttttacngtcagtctagtatagtacgtcgtcctcgtacgtacgtttcggacgtacgggacctacgtacgtaaagtaaactacgaaacggtacgtcggtacgtcgtaacgacctaccgtacgttactcgttacctactaccg

SEQ ID NO: 337531 - DNA, 515 bp, Homo sapiens
  misc_feature: GZ8MTXP02IHEAS.11.81.H04.1.454.CMB.2.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacaacttagcctggtaccagcagaactggccaggctccaggctcctcatctatggtncatcccaccgaggggccactcgggtactcccagcccaggttcaggtcggcaggtgggtctggggacagtgttcactctacaccatcagcagctgcagtctagaagttatttgacttagttttactgtcagtctagtatagtactcgccttcgtactacgtttgaccgagggactaagctaagaactaacaaacgtactgtgactgcacactctcgtcttctac

SEQ ID NO: 337532 - DNA, 633 bp, Homo sapiens
  misc_feature: GZ8MTXP02JKIJV.11.81.H04.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggaagaaatagtgatgacgcagtctccagccaccctgtctgtgtcctccgaggggaaancgcccaccctctcctgcagggccagtcagagtgtagcaacaacttgcctggtaccagcaagaacctggccaggcctcccgaggcctcctnatctagtggtncancccgaacgnggccagtcggtactcccgagaccgtaggttcaggtcggcgtagggtgggttcgaggggacctaggtcgtttcaacgttcaccactatcgagcacgtcctacgcgtacgtcgtagtaacgttagttttacggtactttacgtttttacgtgttacgtaagtacgttagttacttaacgggtaactccggttacccttaccgttacgttacgtttcgggaccggtaacgggtaaccgtaacggactaaacgtaaacgtaaccgtaaacgtaacgtacgtacggctaacggaccactactcgttcgtacctttactacccg

SEQ ID NO: 337533 - DNA, 576 bp, Homo sapiens
  misc_feature: GZ8MTXP02JVOJ6.11.81.H04.1.454.CMB.2.raw
  modified_base (200)..(200): a, c, t, g, unknown or other
  misc_feature (200)..(200): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttgcctggtaccagcaagaacctggccaggctcccaggcctcctcatctatggtgcactccaccgagggccacgtggtactcccgagcctaggttcaggtcggctaggtgggtctggggacaggtcgttcactcctcacctatcagcacgcctgctagtctagagtatttgcttagtttttactgtcagtctagtatagttaacgtcggtccttaccgtactacgtttcggaccgtacggggaacctaacggtactaaaggaaactacgaaaacgtacgtacggtacggtacgtaacggtacctaccgtacttccgtacgttccttactaccg

SEQ ID NO: 337534 - DNA, 651 bp, Homo sapiens
  misc_feature: GZ8MTXP02JCBRK.11.81.H04.1.454.CMB.2.raw
  modified_base (200)..(200): a, c, t, g, unknown or other
  misc_feature (200)..(200): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagcctgtaccagcagaaacctggccaggctcccaggcctcctcatctatggtgcactcccaccgagggcccacgtcgggtactccccgagccctaaggttcaggttcgggctagggtcgggtctggggaaccaggtcgtttccacgttcctaccaccgtaatccagccagccctgcagtctagtaacgttagttttgtacgtttagtttttactgttacctagtactagttaattaagttaaaccgtccgtacccttaccgttaacttacgtttcgggacccgtagggggtaaccctaaaggtaccgtaaaagtaaaacgttaccgaaaaacggttaacgtacgggttacggaccgttaaggacccgtaaccgtacttaccgttcggtttacctttacgttacccg

SEQ ID NO: 337535 - DNA, 529 bp, Homo sapiens
  misc_feature: GZ8MTXP02GP0FQ.11.81.H04.1.454.CMB.2.raw
  modified_base (199)..(199): a, c, t, g, unknown or other
  misc_feature (199)..(199): n is a, c, g, or t
  modified_base (363)..(363): a, c, t, g, unknown or other
  misc_feature (363)..(363): n is a, c, g, or t
  modified_base (402)..(402): a, c, t, g, unknown or other
  misc_feature (402)..(402): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgttagcaacaacttagcctggtaccagcagaaacctggccaggctcccaggctcctcatctatggtgcatccaccagggcccatgggtactcccgagcctaggttcaggtcgcaggttgggctggggacaggngttcactctacaccatcagcagcctgcagtctagaagtntttgcttagtttttactgtcagctagtatagtactcgtccttcgtactacgtttcgacgacgggaccaagtctaagaaactacaaacgtacgtacgtggactgctaacctatctcgttacttctacg

SEQ ID NO: 337536 - DNA, 586 bp, Homo sapiens
  misc_feature: GZ8MTXP02GCIP8.11.81.H04.1.454.CMB.2.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcaacacttagcctggtaccagcagaacctggccaggctccaggctcctnatctatggtncatccacngggccactggtactcccagccaggttcaggtcggcaggtgggtctgggacaggtgttcactcncaccatcagcagccctgcagtctagtaagttattttacgtctttagtttttaactggttactaggtctaggttattagtaacgtcgtccgttcgtacgttacgtttggaccgtacggggtaaccaacggtacgtaaaggtaaaactaaccgaaaacggtaaccgtaggtacggtacgtaacggacctaaccgtacttccttacggttaccttcttaacccg

SEQ ID NO: 337537 - DNA, 543 bp, Homo sapiens
  misc_feature: GZ8MTXP02I9D4U.11.81.H04.1.454.CMB.2.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctntcctgcagggccagtcagagtgttagcaacaattgcctggaccagcagaacctggccaggctcccaggctccnatctatggtncatccacagggccactgggtactccccgagcctagggttcagtcggcaggtgggtctgggacagtgttcactcctcaccatcagcagcctgcgagtcgtagacgtatttggtcttagtttttctagttctagtctagtatagtaactcggtcctacgttacgtacgtttcggaccgtaggggacctaagaccttaaggaaactacgaaacgtacgtacgtcggactcgaccactactcgtacgtctttactacg

SEQ ID NO: 337538 - DNA, 578 bp, Homo sapiens
  misc_feature: GZ8MTXP02F5RCD.11.81.H04.1.454.CMB.2.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcaacaacttagcctggtaccagcaagaaccctggccaggcctcccgaggcctcctcatctagtggtncatccaccgagggcccaagtcggactcccgagccaggttcaggtcgcgaggtgggtctggggacaggngttcactctcaccntccancagccctgctagtctagaacgttagtttgtactttagttttactgttacagtactaagttactagttaacgtcgccttcgtacgttacgtttcggaccgtaggggacctaaggtactaaagaaacgttacgaaaacgtacgtacggtcggactaacggcctaactacttcgttacgtaccttctacc

SEQ ID NO: 337539 - DNA, 624 bp, Homo sapiens
  misc_feature: GZ8MTXP02HJM9C.11.81.H04.1.454.CMB.2.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctcncctgcagggccagtcagagtgttagcaacaattagccctggtaccagcaagaaacctggccaggcctccaggcctccncatctatggtncatcccaacagggccctacgtggtactcccagccgtaggttcaggtcggacaggtgggtacgtggggacctaaggcgtttcactctaccaacctntacacgcacgccgtgcgagtcgtagtaagttatttcgtacgtttagtttttacgtagttcagtacgtaagtattaagtaaacgttcgtaccgttacccgttaacgttacgttttacgggacccgtaacggggaaacccgaaggtaaccgttaaagaaaactaaccgaaaacgtaacgtaccggtaggtacctaacggaccacctaactcttacgttacctttacttacccg

SEQ ID NO: 337540 - DNA, 575 bp, Homo sapiens
  misc_feature: GZ8MTXP02HK9ZS.11.81.H04.1.454.CMB.2.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagacaacaacttagcctggtaccagcagaaacctgccaggctccaggctccncatctatgncactccacgagggccacgtgggtacncccgagcctaggttcagtcggcaggtggggtctgggacagngttcactctacacatcagcagccctgactagtctagtaaacgttagttttcgtacttagtttttactgttacgagtacttaagttatacgtaactggtacccttacgtacgttacgtttgggaccgtaggggacctaacgtacgtaagaaactacgaaaacgtacgtagtcggtacaacggcctaaccgtactacgttcgtcctttacttaccc

SEQ ID NO: 337541 - DNA, 530 bp, Homo sapiens
  misc_feature: GZ8MTXP02GRJDL.11.81.H04.1.454.CMB.2.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccagtcagagtgttagcaacaacttagcctggtaccagcagaaacctggccaggctcccaggctccncatctatggtncatcccaccaggggccacgtggtactcccagcctaggttcaggtcggcaggtgggtctggggactagngttcactctcaccatcagcacgcctgcgagtctagaagttatttgtcttagtttttactgtcagctagtatagtactcgccttcgtactacgtttgaccgtagggactaagtctagtaaactacgaaacgtactagtgacgtcgacacgtactctcgtactctac

SEQ ID NO: 337542 - DNA, 563 bp, Homo sapiens
  misc_feature: GZ8MTXP02HQMY9.11.81.H04.1.454.CMB.2.raw
  modified_base (200)..(200): a, c, t, g, unknown or other
  misc_feature (200)..(200): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccaccctctcctgcagggccagtcagagtgttagcaacaacttagcctggtaccagcaagaacctggccaggctcccaggcctcctcatctatggtgcactcccaaccgagggcccacgtggtactcccgagccctaggttcaggtggctaggtgggtctggggacaggtcgttccactctaccaaccatcagcacgcctgcagtctagaattatttgtcttagtttttactgtactagtactagttattagtaacgtcggtccttacgttactacgtttggaccgtaggggaccaagtactaagtaaactacgaaaacgacgtagtcggactcgacacctatcgttcgttcttactaccg

SEQ ID NO: 337543 - DNA, 581 bp, Homo sapiens
  misc_feature: GZ8MTXP02HVKSE.11.81.H04.1.454.CMB.2.raw
  modified_base (359)..(359): a, c, t, g, unknown or other
  misc_feature (359)..(359): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcaagaaacctggccaggcctcccaggctcctcatctatggtgcatcccaccagggccactggtactcccagccaggtcaggtcggcagtgggtctggggacnggagtttcacttctccaccatcagcagcctgcagtctagtagtattttgtctttagtttttactgttctagtcgtagttataagttacctcggtacccgttccgttacgttcgtttttacgggaccgtacgggggaacctaacgtacgtaagtaaaacttaacgaaaacgtaaccgtggtacggacgtcgtaccaacctacgttccttcgttctttctaccg

SEQ ID NO: 337544 - DNA, 579 bp, Homo sapiens
  misc_feature: GZ8MTXP02FS7FW.11.81.H04.1.454.CMB.2.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (409)..(409): a, c, t, g, unknown or other
  misc_feature (409)..(409): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacacttagcctggtaccagcagaacctggccaggctcccaggcctctcatctatggncactccaaccagggccactggtactcccagccaggttcagtcggcagtggggtatggggacnggtcgttcaacttcncacctatccagcagccctgcagtctgaagtattttgnttagtttttactgttcagtctagtatagtaacgtgacctaccgtactactttcggaccgaacgggggtacctaaacggtacctaaaggtaaaacttaccgaaaacggtaaaccgttaggacggtacgtgaccctaacctacttaccgttacgttcctttactttaacccg

SEQ ID NO: 337545 - DNA, 592 bp, Homo sapiens
  misc_feature: GZ8MTXP02GBAG5.11.81.H04.1.454.CMB.2.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagcctggtaccagcagaacctggccaggctcccaggctcctcatctatggtncactccaccgngggccacgtggtactcccagccaggttcaggtcgcaggtcgggtctggggacaggtcgttcactctacacctatccagcagccctgcagtctagaagtagttttgctttagtttttactggttactaggtactaaggttaattaacggttaaacgttccgggtcccttaccggttaaccttacgttttacgggaccgtaacgggggaacctaacgtaccgtaaaggaaacttaacgaaaacgtaacgtggtaacggctaagacctaactactcgttctcttactacc

SEQ ID NO: 337546 - DNA, 543 bp, Homo sapiens
  misc_feature: GZ8MTXP02IWB1W.11.81.H04.1.454.CMB.2.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (364)..(364): a, c, t, g, unknown or other
  misc_feature (364)..(364): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccacctctcctgcagggccagtcagagtgtancaactacttgcctggtaccagcagaacngcagctccagctcnatcagtgncatcccacgngggccacgtgtactccagcctaggttcaggttcggcagggttgggtcgtgggacagtgttccactctacaccngtcagcagcctagcagtcgtagaagttatttcgtattagttttactgttctagtactagttatacgtaacgtcgccttacgttactacgtttggaccgaggtaccgtaagcgtaaagaaactacgaaacgtacgtcgtacggtctaacgactaccttatccttcgtttacttccttacc

SEQ ID NO: 337547 - DNA, 579 bp, Homo sapiens
  misc_feature: GZ8MTXP02F4V3B.11.81.H04.1.454.CMB.2.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (547)..(547): a, c, t, g, unknown or other
  misc_feature (547)..(547): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcgagggccagtcagagtgttagcaactaacttagcctggtaccagcagaacctggccagctcccaggctcctcatctatggtncatccaccgagggccacgtggtactcccagccaggttcaggtcggctaggtgggtcgtgggaccaggtcgttccaacttctaccacctatcgagcacgccgtgacgtagttcgtagaacgttattttcgtacgtttagtttttactgtactagtactagttaattacgtaacgtccggtaccttacgtacttacgtttcggaccgtaggggaacctaacgtactaaagaaactacgaaacgtacgtacgnggtactcgactacctactcgtcgtctactacc

SEQ ID NO: 337548 - DNA, 602 bp, Homo sapiens
  misc_feature: GZ8MTXP02GAZRW.11.81.H04.1.454.CMB.2.raw
  modified_base (201)..(201): a, c, t, g, unknown or other
  misc_feature (201)..(201): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaancgccaccctctcctgcgagggccagtcagagtgttagcaactaacttgcctggtaccagacaagaacctggccaggcctcccgaggcctcctcatctagtcggtgcactcccgaccgacggggccacgtcggtactccccgagccgtaggttccaggtcggacgtagggtcggggtacgtaggggactaggtcgttcaacgttcctaccacctatcgagcacgcctgcgagtctagtaagttatttcgtacttagtttttcgagttctagtactaagtatagtaacgtcgtccgttcgttacgttacgtttggaccgtaacggggaactaacgtactaaagaaactaacgaaacgtacgtacgtcgacgtaacgactactacgtctacttacttactaccg

SEQ ID NO: 337549 - DNA, 515 bp, Homo sapiens
  misc_feature: GZ8MTXP02H7LK6.11.81.H04.1.454.CMB.2.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctccncatctanggtncatcccacnggcactggtatcccagccaggttcagtcgcaggtggtctggggacagngtttcactctcaccatccagcagccctgcagtctgaagtattttgcttagtttttactggtctagctaagtatagtaaactggtcctcgtactactttggaccaggggaccaagctaagaaatacaaacgaactcgtaggctgacaccatctacgtctctac

SEQ ID NO: 337550 - DNA, 560 bp, Homo sapiens
  misc_feature: GZ8MTXP02GAQ27.11.81.H04.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (392)..(392): a, c, t, g, unknown or other
  misc_feature (392)..(392): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccaccctctcctgcagggccagtcagagtgttagcaacacttagcctggtaccagcagaaacctggccaggctcccaggctcctnatctatggtgcatccaccgagggccacgtggtactcccagccaggttcagtcgcagtgggctgggacagtgttcactctcaccatcagcagcctgcagtctagaattntttgcttagtttttactgtctagctagtagttagtaacgtcggtccttacgtacttacgtttcggaccgtaacggggaacctaaggacgttaaagaaacgttaacgaaaacgtacgtaggtacgaccgttcgacctaaccgtattaccgttcgttacctttactaccg

SEQ ID NO: 337551 - DNA, 545 bp, Homo sapiens
  misc_feature: GZ8MTXP02IJ81E.11.81.H04.1.454.CMB.2.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
  modified_base (418)..(418): a, c, t, g, unknown or other
  misc_feature (418)..(418): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagcctggtaccagcaagaaacctggccaggctcccaggcctcctcatctatggtncatcccaccgagggccacgtggtactcccagccaggttcaggtcggcaggtgggtctggggacagtgttcactcncaccatcagcagcctgcagtctagaagtatttgcttagtttttacngttcagtctagttaatacgtaactcggtcccttaccgtacttacgtttcggaccgtaggggaacctaacggtactaaaggaaactacgaaacgtacgtgtaggctgacactactactcgtcttctac

SEQ ID NO: 337552 - DNA, 554 bp, Homo sapiens
  misc_feature: GZ8MTXP02FP1GA.11.81.H04.1.454.CMB.2.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagcctggtaccagcagaaacctggccaggctcccaggctcctnatctatggtncatcccaccgagggcccacgtggtactccccgagccaggttcaggtcggcaggtgggtctggggacagtgttcactctcaccatcancagccctgctagtctagaagttattttgtcttagtttttacngttcagtatagtaatagttaactcggtccttcgtactacgtttggaccgtagggggaacctaacggactaaaggaaacttacgaaaacgtaacgtgtacggactcggacacctatctcgtcttcttaccg

SEQ ID NO: 337553 - DNA, 642 bp, Homo sapiens
  misc_feature: GZ8MTXP02F9EGH.11.81.H04.1.454.CMB.2.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcaacaacttagcctggtaccagcagaacctggccaggctcccgagctcctnatctagtggtncactccaccgagggccacgtggtacctcccgagccgaggttcaggtcgcgtaggtggtcgtagggacagtacgtcacgtctacgaccagtcacgcacgtccctgactagtcgtagaagtttagttttacggtacgtttaacgtttttacgtacggttacctaaggtacgttaagttaagtaacggttaacgtccgtacccgttaccgttacgttaacggttttcggaaccggtaagggtaacctaacggtacgtaaacggtaaaacttaaaccgaaaacgttaccgtaacggtcgtacgtaacggtaccctaacctacgtaccgtttcgttacctttacctaaccg

SEQ ID NO: 337554 - DNA, 580 bp, Homo sapiens
  misc_feature: GZ8MTXP02JY20F.11.81.H04.1.454.CMB.2.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtcctccagccaccctgtctgtgtctccaggggaaanagccacctctcctgcagggccagtcagagtgttagcaacaacttagcctggaccagcagaacctggccaggcctcccaggctcctnatctatggtncactcccacgagggcccacgtggtacctcccagcccgtaagggttcaggtcggctaggggtcgggtccgtggggacagtcgttccacttctccacctagtcacgcacgcctgctagtctagtaagtatttcgtactttagtttttactgtctagtctagtatagtacgtcggtacctacgttactacgtttcggaccgtacgggaacctaacgtactaaaggaaactacgaaacgtaacgtacgtacggtactcgacctacctactcgtacgttactacgtacc

SEQ ID NO: 337555 - DNA, 525 bp, Homo sapiens
  misc_feature: GZ8MTXP02FE696.11.81.H04.1.454.CMB.2.raw
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
  modified_base (500)..(500): a, c, t, g, unknown or other
  misc_feature (500)..(500): n is a, c, g, or t
tcagcgagagataccacgaccggtgctcgatttagtagtgtagattcgcgggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacctctctgcagggccagtcagagtgttagcaacaacttagcctggtaccagcagaaacctggccaggctcccaggctcctcatctatggtgcatccaccagggccaactggtatcccagccaggttccaggtcggcagtgggtctggggacagngtcactctcaccatcagcagccctgcagtctagaagtattttgcttagtttttactgttcatcagtataagtaactggcctcctactactttggaccgtagggggacccaaggtacctaggaaaactacgaaaacgaaccttgnggctcgcaccatctgtaactctaac

SEQ ID NO: 337556 - DNA, 512 bp, Homo sapiens
  misc_feature: GZ8MTXP02FF555.11.81.H04.1.454.CMB.2.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagcctggtaccagcagaaacctggccaggctccaggctctcatctatggtncatccacagggccatggactcccagccaggttcagtggcaggtggtctggggacagtgtcactctcacatcagcagcctgcagtctagagtatttgcttagtttttactgtcagctagtatagtaactcggcctaccgtactactttggcgtacggggacaacgactagaaactacgaaacgacgttagcgcgtaagacaccatctacgtcttctacc

SEQ ID NO: 337557 - DNA, 599 bp, Homo sapiens
  misc_feature: GZ8MTXP02HKUWQ.11.81.H04.1.454.CMB.2.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagcctggtaccngcagaacctggccaggctcccgaggcctcctcatctagtggtncatcccaccgaggccacgtggtactcccgagcctaggttcaggtcggctaggtcgggtctggggacngtacgttcactctcaccntcacncacgccttgcgtagtactagtaagttattttgtcgtttacgtttttacttgtacgtagtactagttaagttaacgtaaccgttcggtacccttacgttacgttacgttttcggaccgtaacggggacctaaacggtactaaagaaacgtacgaaaacgtaaccgtggtacggccttaacgcctaacctacgttctcgttctttactaccg

SEQ ID NO: 337558 - DNA, 545 bp, Homo sapiens
  misc_feature: GZ8MTXP02F8HC2.11.81.H04.1.454.CMB.2.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgttagcaacaacttgcctggtaccagcagaaacctggccaggctcccaggctcncatctatggtncatcccacgagggccacgtggtactcccagtcccaggttcaggtcggcagtgggctgggacagngttcactctcaccatcancagcctgcagtctagatatttgtcttagttttacngtntagctagtatacggtactcgtccttacgtacgttacgtttcggaccgacggggaccaaacgtacgtaaagtaaacgtaacaaaacggtaactggtcgtacgtgaccaccgtactacttcgtctacttacc

SEQ ID NO: 337559 - DNA, 590 bp, Homo sapiens
  misc_feature: GZ8MTXP02F6ULV.11.81.H04.1.454.CMB.2.raw
  modified_base (200)..(200): a, c, t, g, unknown or other
  misc_feature (200)..(200): n is a, c, g, or t
  modified_base (285)..(286): a, c, t, g, unknown or other
  misc_feature (285)..(286): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagngccacctctcctgcagggccagtcagtagtgttagcaacaacttagcctggtaccagcagaaacctggccaggctcccagctccnntctatggtncatccacgngggcctactggtactcccgagccgaggttcaggtccggcagggttgggctgggactaggtcgttcacttctacaccagtcagcagccagcagtctagacttagtttgtctttagttttactgttctagtctaagttactaacgttaacgtcggtaccttacggttacttacgtttcggaccgtacggggtaactaacgagttaaacgaaacgttaaacgaaacggtaacgtacgtacggtaccgtaaggaccaacgttactccgttacgtttacctacgttacccg

SEQ ID NO: 337560 - DNA, 616 bp, Homo sapiens
  misc_feature: GZ8MTXP02HUEZ4.11.81.H04.1.454.CMB.2.raw
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggtcagtcagagtgttagcaacaacttagcctggtaccagcaagaaccnggccagcnccagctctnatctatggtncatccaccagggccagtggtacnccagccgtaggtcaggtcggcaggtcgggtcgtggacagtcgttcatcctcacntacngcacgcctgcagtctagtaagttatttgctttagtttttactgttactagtacgtagtaattacgttaacgtcggtacccttacccgttaacgttaccggttttacggacccggtaacggggtaaccctaaacggtacgttaaacggtaaaacgtacgtaaaaacccggtaacggttcggttaaccggaccgttaacgtacccgtaccttacgtctttaccggttctttacccttacccg

SEQ ID NO: 337561 - DNA, 559 bp, Homo sapiens
  misc_feature: GZ8MTXP02FPQ10.11.81.H04.1.454.CMB.2.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
tcagcgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaactaacttagcctaggtaccagcaagaaacctggaccaggcctcccgaggcctcctcatctagtggtcncactccacgagggccacgtggtactcccgagtccgtaggttcaggtcggcgtaggtgggtacgtgggactagtcgtcacgtctacgacntcngcngctgcagtctagattgtttagtcttagttttcngtcagtactagtatacgtacgtcgtcctacgtacttacgttcggacgtacgggaccaagtacgtaagtaaactacgaaacgtacgtacgtcgactcggactacgtactcgtacgtccttactacc

SEQ ID NO: 337562 - DNA, 584 bp, Homo sapiens
  misc_feature: GZ8MTXP02FP32X.11.81.H04.1.454.CMB.2.raw
  modified_base (147)..(147): a, c, t, g, unknown or other
  misc_feature (147)..(147): n is a, c, g, or t
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccatggaanaaatagtgatgacgcagtctccagccaccctgtctgtgtctccgaggggaaangccaccctctcctgcagggccagtcagagtgttagcaaacaacttagcctggtaccagcagaacctggccaggctccaggctccncatctatgncatccacagggccagtggtactcccgagccaggttcaggtcggcaggtggggtctggggacagggtgttccacttcctacaccatcgagacagcctgcagttcgtagaagttagttttgttacttagtttttactggttacagtacgtagttaattacggttaacttcggtaccttaccgttacgttacgtttacgggaccgtacggggaacctaacgtacgtaaagtaaactaacgaaaacgtaacgtaggtcgtacgtcgaccaactacttcgtacgttctttactac

SEQ ID NO: 337563 - DNA, 778 bp, Homo sapiens
  misc_feature: GZ8MTXP02GM41Z.11.81.H04.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagcgagagataccacgaccggtgctcgatttagtagtgtagattcgcggggggaggaactgctcagttaggacccagacggaaccatggaagccccagcgcagcttctcttcctcctgctactctggctcccagataccactggagaaatagtgatgacgcagtctccagccacctgtctgtgtctccgagggaanacgccacctctcctgcgagggccagtcagagttgttagacaactaacttagcctagggtaccagacacgaacctggccacggcctccgaggctcctanactctagtggtgactactccgaccgacggacctacgtacgtaccgtaccgacgtccgtaagggttcgaggtcggaccgtagggtcggggtaccgtaggggaacctagggtaccgttccaaccttccgtacctaacccgtacttacgacgaccgtaacggtcctcggacgttacgtaccgttagtaaacgttttacgttttaacgttacgtttttaacgtttttaaccgttcggttaaccgtaaggttaacccgttaaagtttaaccgtttaaacgggtttacccgttacccgggttacccgtttaccggtttaacccggtttacgggttttaccgggaacccgggtaaacgggggtaaacctaaaacggttacgtaaaaaggtaaaccgtaaaccggtaaaaccggtaacgttacgggtacccgtaacggtaacgtaccctaacggttacttaacggtttccttacctttaccgttaacccg

SEQ ID NO: 337564 - DNA, 578 bp, Homo sapiens
  misc_feature: GZ8MTXP02G2BT4.11.81.H04.1.454.CMB.2.raw
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
tcagcgagagataccacgaccggtgctcgatttagtagtgtagattcgcgggggaggaactgctcagttaggacccagatggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcaacacttagcctggtaccagcagaaacctggccaggcctcccaggcctcctcatctatggtgccatcccaccgngggcccacgtggactcccagccaggttcagtggcaggtgggtctgggacngtagttcactctccacatcacgcgacgctgcagtactagtaagtattttgactttagtttttactgttacagtctagtattacgtaacgtcggtacccttaccgtacgttaccgttttacggaccgtaacggggtaccgaagtaccgtaaagtaaaacttaacgaaaaccgtaacgttagtacggtctacgacctaccagttacctcggttctttaccg

SEQ ID NO: 337565 - DNA, 572 bp, Homo sapiens
  misc_feature: GZ8MTXP02JUTNW.11.81.H04.1.454.CMB.2.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
tcagcgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgccaccctctcctgcagggccagtcagagtgttagcaacaacttagcctggtaccagcagaacctgccaggctcccaggctcctcatctatggtncactccacgagggcccacgtggtactcccgagccgtaggtcaggtcggcaggtggtctgggacngtgtcactctccactatcagtcagcctgctagtctagacgttatttcgtactttattttactgtactagtctagtatacgtacgtcgtaccttacgttacttacgtttcgccggaaggggtaaccaacgggtactaaacggaaacgtaacgtaaaaccgtacgtacggtacgacgtaacgacctactacgtctacgttacttacttaccc

SEQ ID NO: 337566 - DNA, 522 bp, Homo sapiens
  misc_feature: GZ8MTXP01DPNRQ.39.25.C03.1.454.CMB.2.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
tcagtcgcactagtcacgaccggtgctcgatttagtagtgtagatttgggtttggggaggaactgctcagttaggacccagacggaactatggaagcccagcgcagcttctcttcctcctgctactctggctcccagataccattggagaaattgtgatgacgcagtctccagccacctgtctgtgtctccaggggaaangccaccctctcctgcagggccagtcagagtatcaccagcaacttagcctggtaccaccagaaacttggccaggctcccaggctcctcatctatggtncatcccaccagggcccactggtactcccaactggttcagtggccaggtggtctgggacaagaattcactctcacatcagcagcctgcagtctgaagtactttggagtttattcngtcagcagttataataactgcctgtgtcctggacgttcggaccgaagggaacctaaaggttggaaattcgaaaacgtaacttggttgctgcaaccatcttgtcttcgtaac

SEQ ID NO: 337567 - DNA, 231 bp, Homo sapiens
  misc_feature: GZ8MTXP01C6C7L.39.25.C03.1.454.CMB.2.raw
  modified_base (230)..(231): a, c, t, g, unknown or other
  misc_feature (230)..(231): n is a, c, g, or t
tcagtcgcactagtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnn

SEQ ID NO: 337568 - DNA, 234 bp, Homo sapiens
  misc_feature: GZ8MTXP01C5Y3X.39.25.C03.1.454.CMB.2.raw
  modified_base (231)..(234): a, c, t, g, unknown or other
  misc_feature (231)..(234): n is a, c, g, or t
tcagtcgcactagtcacgaccggtgctcgatttagtagtgtagatttgggtttgggtgcccaagctgctggagggcacggtcaccgtctcctcagcctccaccaagggcccatcggtcttccccctggccaccctcctccaagagcacctctgggggcacagcggccctgggctgcctggtcaaggactacttccactagtgcgactgagcgggctggcaaggcgcatagnnnn

SEQ ID NO: 337569 - DNA, 232 bp, Homo sapiens
  misc_feature: GZ8MTXP01DN5D2.39.25.C03.1.454.CMB.2.raw
  modified_base (230)..(232): a, c, t, g, unknown or other
  misc_feature (230)..(232): n is a, c, g, or t
tcagtcgcactagtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnn

SEQ ID NO: 337570 - DNA, 506 bp, Homo sapiens
  misc_feature: GZ8MTXP01EUG2Y.39.25.C03.1.454.CMB.2.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (505)..(505): a, c, t, g, unknown or other
  misc_feature (505)..(505): n is a, c, g, or t
tcagtcgcactagtcacgaccggtgctcgatttagtagtgtagatttgggtttgggggaggaactgctcagttaggacccagacggaactatggaagccccagcgcagcttctcttcctcctgctactctggctcccagataccattggagaaattgtgatgacgcagtctccagccacctgtctgtgtctccaggggaaangccacctntcctgcagggccagtcagagtancacagcaacttgcctgacacagaactgcagctccagctctcatctatggtncatccacgagggccactggtactcccaacnggtcagtgcaggtggctgggacaagaattcactctcaccatcagcagcctgcagtctagaaagtcttttgggattttattctgttcagcaagttataataactggcctcgtgtcctggtacgttcggaccgaagggaaccaaagttggaaacttacgaaacgacttgttggctgcaacatcttagtcttcnc

SEQ ID NO: 337571 - DNA, 545 bp, Homo sapiens
  misc_feature: GZ8MTXP01D5NK6.39.25.C03.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (397)..(397): a, c, t, g, unknown or other
  misc_feature (397)..(397): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctcccagataccattggagaaattgtgatgacgcagtctccagccacctgtctgtgtctccgaggggaaangccacctctcctgcagggccagtcagagtatcacagcaacttagcctggaccacagaactggcaggctccaggctcnatctanggtncactccacgaggccagtcggtactccccaaacgtggttcaggtcggccaggtgggtctggggacagagttcactctacaccatcgagcagcctgcagtctagaagtntttgctagtttatactgtacaagtagtacaatgactcggtaccttctactcgtttcgggacgggtacgggacgtaagggtggaaggtacttacgaaacgtacgttggttcgggactcggactaacctattcgttcgttcttcgtaacc

SEQ ID NO: 337572 - DNA, 583 bp, Homo sapiens
  misc_feature: GZ8MTXP01DA69H.39.25.C03.1.454.CMB.2.raw
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgacaggcccctggagaaggacttgagtgggtgggaggcatcatccctcgctttgctacaccaacctacgcacagaaattccaaggcagagtcacgatttccgctgacgaatccacgaacacggcctatctagaactgagcagccttaagtctagaggacacggccatttattactgtgcaaagagactcaccctctaccgacggtcggggaccaaaggggacccaggggtccaccggtctccctcacgccctaccgaccgaacggggcccctagtcccgttccccttacccgcgacccctccctccaaccgaacggccgaccgtacctcggggcggaccacgcggcccgtcggtcgtctcgcgtcgacgacgtccttcgtacctagttcgcgacgtgtagcggcgtgcgaacgcgaacg

SEQ ID NO: 337573 - DNA, 574 bp, Homo sapiens
  misc_feature: GZ8MTXP01CCW4L.39.25.C03.1.454.CMB.2.raw
  modified_base (282)..(282): a, c, t, g, unknown or other
  misc_feature (282)..(282): n is a, c, g, or t
  modified_base (412)..(412): a, c, t, g, unknown or other
  misc_feature (412)..(412): n is a, c, g, or t
tcagtcgcactagtcacgaccggtgctcgatttagtagtgtagatttgggtttgggggaagaggaagactgacggtcccccaggagttcaggtgctgggcacggtgggcatgtgtgagttttgtcacaagatttgggctcaactctcttgtccagtccctggtgcagctgctgcagtcggggactgaggtgaaggagcctgggtcctcggtgagggtctcctgcaaggcttcgtggaggcaccttcggcaactatcctatcacctgggtgcgacaggccccnggagaaggacttgagtgggtggaggcagtcatccctgctttgctacaccaactagcacagaaatccaaaggcagagtcacgaatttccgctgaacgaaactccaacgaacacgcctatcctagaactgancagaccttaagctagagacacggcctaagtttatactgtagacaagagatacaccctcctacacgtcgggaaccgaaacggaccgacggttacgtaaccgtccttcccgttccacgccctcccaacccgaacggacccgaccgtccgttcccgtttcccccg

SEQ ID NO: 337574 - DNA, 232 bp, Homo sapiens; identical to SEQ ID NO: 337569
  misc_feature: GZ8MTXP01CZHNK.39.25.C03.1.454.CMB.2.raw
  modified_base (230)..(232): a, c, t, g, unknown or other
  misc_feature (230)..(232): n is a, c, g, or t

SEQ ID NO: 337575 - DNA, 232 bp, Homo sapiens; identical to SEQ ID NO: 337569
  misc_feature: GZ8MTXP01BHFTF.39.25.C03.1.454.CMB.2.raw
  modified_base (230)..(232): a, c, t, g, unknown or other
  misc_feature (230)..(232): n is a, c, g, or t

SEQ ID NO: 337576 - DNA, 546 bp, Homo sapiens
  misc_feature: GZ8MTXP01DSKQF.39.25.C03.1.454.CMB.2.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (363)..(363): a, c, t, g, unknown or other
  misc_feature (363)..(363): n is a, c, g, or t
tcagtcgcactagtcacgaccggtgctcgatttagtagtgtagatttgggtttgggggaggaactgctcagttaggacccagacggaactatggaagcccagcgcagcttctcttcctcctgctactctggctcccagataccattggagaaattgtgatgacgcagtctccagccacctgtctgtgtctccgaggggaaangccacctctcctgcagggcagtcagatatcacagcaacttagcctggtaccaccagaaactggccaggctcccaggctcncatctatgtncatccacagggccatggtactcccgaactggttcagtgccaggtggtctgggacaagattcactctacacntcagcagcctgcagtctagtaagtctttggacttttattctgtacagtactaagttaataaataacgtcggccttacgtgttacccgttggaaccgtttcggaccgaaaggtaacgaaaacgttgggaaaattcgaaaacgtacgttagttggcctaaggactaacatcttacgtcttcaacc

SEQ ID NO: 337577 - DNA, 634 bp, Homo sapiens
  misc_feature: GZ8MTXP01DN5ST.39.25.C03.1.454.CMB.2.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (468)..(468): a, c, t, g, unknown or other
  misc_feature (468)..(468): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctccagataccattggagaaattgtgatgacgcagtctccagccacctgtctgtgtctccgaggggaaangccacctntcctgcagggccagtcagagtatcacagctaacttgcctggaccacagaactggcagctcccagctcctnatctagtggtcncacgtcccaaccgngggcccctaagttcgggtaactacccccgaaacgtaggtttacaggttcggaccgagggttcggggtctaggggacctaaggtaactttccacttctaccacctatcgagcacgtctgactagtctagaagttctttaggtatttacttcgtagtctaaggntaaagttaataacgtaactggtccttgtcgttaccgtgtaccggttacggaacccgtaaaggggaaacctaaagggttacggtaaaacttccgtaaaaacggtacttggggttcgttaccgtgaacccaacccgtttattcgggttacttcccgtttgtaaccccg

SEQ ID NO: 337578 - DNA, 724 bp, Homo sapiens
  misc_feature: GZ8MTXP01BAT0S.39.25.C03.1.454.CMB.2.raw
  modified_base (286)..(286): a, c, t, g, unknown or other
  misc_feature (286)..(286): n is a, c, g, or t
tcagtcgcactagtcacgaccggtgctcgatttagtagtgtagatttgggtttggggggaagaggaagactgacggtcccccaggagttcaggtgctgggcacggtgggcatgtgtgagttttgtcacaagatttgggctcaactctcttgtccagtccctggtgcagctgctgcaggtcgggactgaggtgaaggagccgtgggtcctcggtgagggtctcctgcaaggcttctggaggccaccttcggcaactatcctatcaccgtgggtgcgacacggccccnggagaaggcttggaggtggggtgggaggcatcactccctcgtctttgcctacacccaacctacgctaacaagtaaacttccgaaacggcagacgtacaacgtacttcccgctagaaccgaaactcccaaacggaacaccgggtcctaatcgtaagaacgtgaacgacgacgtacccgtttaagtccgtagggaacgacgtaaccgggtccttaaggttttaactttacgtacggttacgaaccgaaaggtacgtaaccttaccccaaaccccgtttcgaccggtaacccggggtcgggggaaccccgtaaacgggggaccccggtaaccggggttacccgtaacccggttccgttaccccgttcccgacgtaacccccgtaccgaacccggtaaccgggccccgttaaccgttccccggttaaccccgttccccccgg

SEQ ID NO: 337579 - DNA, 672 bp, Homo sapiens
  misc_feature: GZ8MTXP01AVJ2U.39.25.C03.1.454.CMB.2.raw
  modified_base (624)..(624): a, c, t, g, unknown or other
  misc_feature (624)..(624): n is a, c, g, or t
tcagtcgcactagtcacgaccggtgctcgatttagtagtgtagatttgggtttggggggaagaggaagactgacggtccccccaggagttcaggtgctgggcacggtgggcatgtgtgagttttgtcacaagatttgggctcaactctcttgtccagtccctggtgcagctgctgcagtcggggactgaggtgaaggagccgtgggtcctggtgagggtctcctgcaaggtcttcgtggaggccaccgttcggactaaactatcctatccaccgtgggtcgcgacgacggcccctaggagaacggtacttaggaggtggggtaggggaggtccaatcgaactccccgtcgtactttcgaccttaaccaaccctaaacccgtacgacaacgaaagtaaacttaccgaaacggcagacgtcaacgtaacttccgctagaaacgtaactacccgaacgaaccgtacggacctaactaccgtaagaacgtaggaacgacgtaacgtacctttaagtccgtaaggacgaacacggtacctaagtttactacgtgtacgaccaaggactactaccgaccctactcgtaacgggtcgggaacgaaacggcgacggttccgaccgtcgaccncgttacgccctacgaaccgtaacggccttacgtccgttcccttccccg

SEQ ID NO: 337580 - DNA, 232 bp, Homo sapiens
  misc_feature: GZ8MTXP01A91VD.39.25.C03.1.454.CMB.2.raw
  modified_base (230)..(232): a, c, t, g, unknown or other
  misc_feature (230)..(232): n is a, c, g, or t
tcagtcgcactagtcacgaccggtgctcgatttagtagtgtagatttgggtttgggtgcccaagctgctggagggcacgttcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnn

SEQ ID NO: 337581 - DNA, 661 bp, Homo sapiens
  misc_feature: GZ8MTXP01B8L3I.39.25.C03.1.454.CMB.2.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctccagataccattggagaaattgtgatgacgcagtctccagccacctgtctgtgtctccgaaggggaaancgccaccctctcctgcgagggccagtcagagtancacagacaacttgcctagaccacagaactggccaggctaccgagcctcctcatctagtggtcacactcccaccgacggaccctacgtcggtaacctaccccgaaacgtggttacgaggtcggacccgtaggggttcggggtaccgtaggggaacctaaaggtaaactttcccaaacttcctaccaccctataccgaagccagtccctaggacctaggtcttaggaaacgtttcgtttagggtactttttatcgtaggtactagtacgtaagtttaataaacgtacgtcggtcctcgttacgtaccgtgggtacccgttacggaccgaaagggtaaccaaaaggttcgaaaacttaccgaaaacggttacgcggttcggcctaacggacctaacctagttccgttacgttcccttaactaacccg

SEQ ID NO: 337582 - DNA, 629 bp, Homo sapiens
  misc_feature: GZ8MTXP01DE87V.39.25.C03.1.454.CMB.2.raw
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagtcgcactagtcacgaccggtgctcgatttagtagtgtagatttgggtttggggggaagaggaagactgacggtcccccaggagttcaggtgctgggcacggtgggcatgtgtgagttttgtcacaagatttgggctcaactctcttgtccagtccctggtgcagctgctgcagtcggggactgaggtgaaggagcctgggtcctcggtgagggtctcctgcaaggcttcgtggacggcaccttcggcaactatcctatccaccgtgggtgcgacacggcccctggagaaggacttggagtgggtgggagcatcatccctcgtctttgctacaccaacctcgcacagaatcgaacgcagngtcacgtactttccgntgaacgtaactccaacgaacacgcctatctaagaactgagcaacgtccttaagtctaggacgtacacggtcctagttttactacgtgtagactaaagacgtactaccgtaccctcgttaccgacgggtaccgggggaaccgtaaacggggaccgtacggggttccctaaaccggttccttacccgttcgaccggtccctacccgaacccgaaccgggccccttaacgttcccggttcccgtttccccccg

SEQ ID NO: 337583 - DNA, 233 bp, Homo sapiens
  misc_feature: GZ8MTXP01EQ54N.39.25.C03.1.454.CMB.2.raw
  modified_base (230)..(233): a, c, t, g, unknown or other
  misc_feature (230)..(233): n is a, c, g, or t
tcagtcgcactagtcacgaccggtgctcgatttagtagtgtagatttgggtttgggtgcccaagctgctggagggcacgttcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnnn

SEQ ID NO: 337584 - DNA, 711 bp, Homo sapiens
  misc_feature: GZ8MTXP01AQTWB.39.25.C03.1.454.CMB.2.raw
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgaacacggcccctggagaaggacttggaggtgggtgggaggcatcatccctcgtcttgctacaccaacctacgcacagaaacttccaaggcagagtcacgtacttccgctgacgaanccaacgaacacggcctatctaagaactgagacacgtaccttaagtcagaggacacggtactatttatactganacaaganactccaccctctacgacggtcgggacgaacgggaccgacgggtcacccggtctacccgtcacgccctaccgaccgaccgggccctacggttcccggttcccttacccccgtcggacccctacccctccgttacccgaacgggaccgtcccgtaacccgttccgggaccgggggacccaaccggtaccgggccccgggtccccggtcgggggtcccgttccggccccggttaacgggtaaccgggttaaaccggttaacccgtttacccgttaccggtaaccgttacgggttccgaccggtaacggtcgggaaccgggccgggggtacgttaccgggaacgaacggggccg

SEQ ID NO: 337585 - DNA, 702 bp, Homo sapiens
  misc_feature: GZ8MTXP01A1KEA.39.25.C03.1.454.CMB.2.raw
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (666)..(666): a, c, t, g, unknown or other
  misc_feature (666)..(666): n is a, c, g, or t
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgacacggcccctggagaaggacttggaggtggggtgggaggcatcactccctcgctttgcctacaccaacctacgcaacagaaattccgaaaggcaagatcacgatttccgntgacaanccagacncgctanctagactgagtcagtccttaagctagaggaccacggtacctaattttacttactgtagacgaaagagactccaaccccttcgtaaccgaacgggttcggggaacccaaagggggacccacggggttaccaaccccggttctaccctcccaacggcccctacccgaaccgaaccgggtacccctaaccgtcccgggttcccttcccccccgtcggaacccctaccccttcccgtaaccccgaacgggaaccgcccgtaacccgttccggtaacgggggcccaacgccggcccggttcccgtcgggccttcggaaccgttcggtaccgaaacgggtaccttacccgttacctaacgttacggcgacccggtntcggcgggcgggttccgaagggtcgaaacggggccg

SEQ ID NO: 337586 - DNA, 672 bp, Homo sapiens
  misc_feature: GZ8MTXP01DQTNE.39.25.C03.1.454.CMB.2.raw
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgacaggcccctggagaaggacttggagtgggtggaggcatcatcctcgcttgctacaccaactacgcacagaaattccaaggcagagtcaacgatttccgctagacgaactccaacgaacacggtcctaatcgtaagaactgacgccacgtcctttaaaggtctagacggactaccgggtaccctatttattacctagttgacctaagagtactcctaaccccttcgtaacgaaccggtcgggggaccgaaacggggtaccgacgggtaccgtacggtcctcctccacggtccctaccgaccgaaccgggaccctaacgttccggtacccttccccgcggacccctaccccttaccacccgtaaaggaccgtaccgtaaccccgtcggtacgggggcccacgttacggccccggccctcggggcctcgccgtaacggtaccgacggtaccttacgttacccacgttacgttcgacgtcgtaggaacgtcgggcgttagccgaaggccg

SEQ ID NO: 337587 - DNA, 659 bp, Homo sapiens
  misc_feature: GZ8MTXP01BB6YI.39.25.C03.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgacaggcccctggagaaggacttgagtgggtggaggcatcatcctgctttgctacaccactacgcacagaaattcaaggcagagtcacgtattccgntgacganccagaacacgtctatctagactgancacgccttaagctaggacgacacggtacctaatttacttactgtgacaacgagtactccaccctcgtaacgacggtcggggacccaaaggggaccctacggggtccctaccggtttccctacaccgtccctaccgaaccgaacgggcccctaacgttcccggttcccttccccgtacgtcccgtacccctccctaccgtaacgcgggtaccgtaccgtcggtacgggggaccacgaccggccggtacccgtcgggtcctcggtcccgtaggtaaccgtaaacgacccgttaccttccgtaacggtacgttcgttaccggaacgtccgggaacggtccgggcgtcgggacaaacggggttcgaacgg

SEQ ID NO: 337588 - DNA, 508 bp, Homo sapiens
  misc_feature: GZ8MTXP02FZW9K.39.25.C03.1.454.CMB.2.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
tcagtcgcactagtcacgaccggtgctcgatttagtagtgtagatttgggtttggggaggaactgctcagttaggacccagacggaaccatggaagccccagcgcagcttctcttcctcctgctactctggctcccagataccattggagaaattgtgatgacgcagtctccagccaccctgtctgtgtctccaggggaaangccaccctctcctgcagggccagtcagagtatcaccagcaacttagcctggtaccaccagaaacttggccaggctcccaggctcctcatctatggtncatccaccagggccactggtatcccagccaggttcagtggcaagtgggtctggggacagngttcactctcattancagcagcctgcagtctagaagtatttagctagtttattactgtcagcagtataatgactggcctagttcggaccaagggaccaaggtgaaatcgaaaacgactgtacggctgctacatctagtcttcattcccg

SEQ ID NO: 337589 - DNA, 241 bp, Homo sapiens
  misc_feature: GZ8MTXP02JFAL4.39.25.C03.1.454.CMB.2.raw
  modified_base (240)..(241): a, c, t, g, unknown or other
  misc_feature (240)..(241): n is a, c, g, or t
tcagtcgcactagtcacgaccggtgctcgatttagtagtgtagatttggtttgggggaagaggaagactgacggtcccccacggagttcaggtgctgaggaagagatggaggtggacgtgtcagcacccggctggggcctgtccctggatgcaggctactctagggcacagcggccctgggctgcctggtcaaggactacttccactagtgcgactgagcgggctggcaaggcgcatagnn

SEQ ID NO: 337590 - DNA, 566 bp, Homo sapiens
  misc_feature: GZ8MTXP02IPL1P.39.25.C03.1.454.CMB.2.raw
  modified_base (204)..(204): a, c, t, g, unknown or other
  misc_feature (204)..(204): n is a, c, g, or t
  modified_base (407)..(407): a, c, t, g, unknown or other
  misc_feature (407)..(407): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctctcctgtagggccagtcagagtgttagctacaacttagcctggtaccagcagaaacctggccaggtcccaggctcatcatctatggtgcactcccaccgagggccacgtggtactcccagccctacgttagcgcaggtgggtctggggacaggtagttcactctcaccatcagcagcctgcctagtctagaagtntttgacttagtttattactgtacaaatagtaactaagtgacgtggccttctcgtacgtttcgggacgggaacggaccgtaagggtggaaacgtaacgtaacgaaaacgtaacgttggtacggaacgtcgacctaccgtattccgttcgtacctttaccg

SEQ ID NO: 337591 - DNA, 547 bp, Homo sapiens
  misc_feature: GZ8MTXP02I2F9W.39.25.C03.1.454.CMB.2.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
tcagtcgcactagtcacgaccggtgctcgatttagtagtgtagatttgggtttgggggaggaactgctcagttaggacccagacggaactatggaagccccagcgcagcttctcttcctcctgctactctggctcccagataccattggagaaattgtgatgacgcagtctccagccacctgtctgtgtctccaggggaaangccacctctcctgcagggccagtcagagtatcaccagcaacttagcctggtaccaccagaaacttggccaggctccaggctcctcatctatggtncatccaccagggccactggtactcccaaacnggttcaggtcggccaggtcgggtctggggacagaattccactctcaccntcagcagcctgcagtctgaagtctttgggattttattcngttacagtcagttataatacgtgccttgtgtccgtggtaccgttcggacccgtaaagggtacctaaaaggttcggaaaacttacgaaaacgtctaggtcggactcggacacctagtctcgtaccttactac

SEQ ID NO: 337592 - DNA, 518 bp, Homo sapiens
  misc_feature: GZ8MTXP02GK41B.39.25.C03.1.454.CMB.2.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (509)..(509): a, c, t, g, unknown or other
  misc_feature (509)..(509): n is a, c, g, or t
tcagtcgcactagtcacgaccggtgctcgatttagtagtgtagatttgggtttggggaggaactgctcagttaggacccagacggaaccatggaagccccagcgcagcttctcttcctcctgctactctggctccagataccattggagaaattgtgatgacgcagtctccagccaccctgtctgtgtctccaggggaaangccacctctcctgcagggccagtcagagtatcaccagcaacttagcctggtaccacagaaactggccaggctccaggctcctcatcatgatgcctcaccnggccactggtactcccagccaggttcagtcggcaagtggggtctggggacaggagttcaactctcattatcagcagcctgcagtctagaagtattagctagttattactgtcagcagtataaatgactggccttaacgttcggacctaaaaggggaccaaagggtggaaaataccgaaaacgaaactgtaggctagaacaccatcctntctctactc

SEQ ID NO: 337593 - DNA, 582 bp, Homo sapiens
  misc_feature: GZ8MTXP02HLFQO.39.25.C03.1.454.CMB.2.raw
  modified_base (355)..(355): a, c, t, g, unknown or other
  misc_feature (355)..(355): n is a, c, g, or t
  modified_base (398)..(398): a, c, t, g, unknown or other
  misc_feature (398)..(398): n is a, c, g, or t
  modified_base (501)..(501): a, c, t, g, unknown or other
  misc_feature (501)..(501): n is a, c, g, or t
tcagtcgcactagtcacgaccggtgctcgatttagtagtgtagatttgggtttgggtgcagctgctgcagtcggggactgaggtgaaggagcctgggtcctcggtgagggtctcctgcaaggcttctggaggcaccttcggcaactatcctatcacctgggtgcgacaggcccctggagaaggacttgagtgggtgggaggcatcatccctcgctttgctacaccaacctacgcacagaaattccaaggcagagtcacgatttccgctgacgaatccacgaacacggcctatctagaactgagcagccttaagtctgaggacacggccatttatactgtgcaagagatcaccctntcacgtgggggccaaaggggaccaggggtccaccgtctccctnacgccctccaccgaagggcccctacgtccgttcccctcccgtcgaccctccctacctacgaacgccgacctcgtcgggcggaccacgcggcccgtcgcggtcncgtcgtcgacgacgtaccttacctaccgtacgttacgcgaccgtaacggtcggacgggtccggcgtacggacggacggccg

SEQ ID NO: 337594 - DNA, 231 bp, Homo sapiens
  misc_feature: GZ8MTXP02JFIP6.39.25.C03.1.454.CMB.2.raw
  modified_base (230)..(231): a, c, t, g, unknown or other
  misc_feature (230)..(231): n is a, c, g, or t
tcagtcgcactagtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggacacagcggccctgggctgcctggtcaaggactacttccactagtgcgactgagcgggctggcaaggcgcatagnn

SEQ ID NO: 337595 - DNA, 540 bp, Homo sapiens
  misc_feature: GZ8MTXP02I7FQB.39.25.C03.1.454.CMB.2.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagtcgcactagtcacgaccggtgctcgatttagtagtgtagatttgggtttgggggaggaactgctcagttaggacccagacggaaccatggaagccccagcgcagcttctcttcctcctgctactctggctccagataccattggagaaattgtgatgacgcagtctccagccacctgtctgtgtctcaggggaaangccacctncctgcagggccagtcagagtatcaccagcaacttagcctgtacacagaactggccagccncngcncncnntngncncncacgcgcnctcgtactacacagtngtgcgngtgtcgtgagagatcactctcacacncacncacgctcncagtacgtagtagtacgttagttagttattactcgtagtagtagtagtaattaagtacgtacgtacgtcgtacgtcgtacggtacggtaccggtacgaacggaaacgtaaacggtaaggtaaacgtaaacgtaaacgtaacgtacgtacgtacgtaacgacgtacgtactacgtacgtcttactac

SEQ ID NO: 337596 - DNA, 328 bp, Homo sapiens
  misc_feature: GZ8MTXP02FZRX4.39.25.C03.1.454.CMB.2.raw
  modified_base (317)..(317): a, c, t, g, unknown or other
  misc_feature (317)..(317): n is a, c, g, or t
  modified_base (323)..(328): a, c, t, g, unknown or other
  misc_feature (323)..(328): n is a, c, g, or t
tcagtcgcactagtcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccatcggtcttcccctgcaccctcctccaagagcacctcgtggggcacagccggccctgggctgcctggtcaaggctactccatagtgcgactgagcgggctggcaaggcncatagnnnnnn

SEQ ID NO: 337597 - DNA, 233 bp, Homo sapiens
  misc_feature: GZ8MTXP02JZOEA.39.25.C03.1.454.CMB.2.raw
  modified_base (231)..(233): a, c, t, g, unknown or other
  misc_feature (231)..(233): n is a, c, g, or t
tcagtcgcactagtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttcccactagtgcgactgagcgggctggcaaggcgcatagnnn

SEQ ID NO: 337598 - DNA, 333 bp, Homo sapiens
  misc_feature: GZ8MTXP02GK94D.39.25.C03.1.454.CMB.2.raw
  modified_base (328)..(333): a, c, t, g, unknown or other
  misc_feature (328)..(333): n is a, c, g, or t
tcagtcgcactagtcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccatcggtcttccccctggccaccctcctccaagagcacctctgggggcacagcggccctgggctgcctggtcaaggactacttccactagtgcgactgagcgggctggcaaggcgcatagnnnnnn

SEQ ID NO: 337599 - DNA, 231 bp, Homo sapiens; identical to SEQ ID NO: 337567
  misc_feature: GZ8MTXP02FJYJD.39.25.C03.1.454.CMB.2.raw
  modified_base (230)..(231): a, c, t, g, unknown or other
  misc_feature (230)..(231): n is a, c, g, or t
